United States Patent 7,745,391 (HUMAN THROMBOSPONDIN POLYPEPTIDE) - sequence listing, part 147

SEQ ID NO: 381408 - DNA, 3943 bp, Homo sapiens
tcgtcttttgataggtggaggatgtttctgtagtcctaggaatccacagtgaattcgagtctagactcagtcatttttcagggtcaggggaggagggagaagtagcaaatcagatatgcccaaaacgttacaggggtaacagtgaatccaggatgctgctatcagcctgtgcattgtgaagaaggcaatcataggcgagcagccgcgggagcaggaacagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccttttgtgtttttttttttttttttttgaagtcttgtataactaacagcatccccaaaacaaaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatataatatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttgtttacacagcttgtggaattatttcgtgggaaaataaatttttataacttctcccacttcaatttctaacc

SEQ ID NO: 381409 - DNA, 3423 bp, Homo sapiens
tcgtcttttgataggtggaggatgtttctgtagtcctaggaatccacagtgaattcgagtctagactcagtcatttttcagggtcaggggaggagggagaagtagcaaatcagatatgcccaaaacgttacaggggtaacagtgaatccaggatgctgctatcagcctgtgcattgtgaagaaggcaatcataggcgagcagccgcgggagcaggaacagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccttttgtgtttttttttttttttttttgaagtcttgtataactaacagcatccccaaaacaaaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatataatatatatatatatatcagtttgatcacactattttagagtcttaatgccagcagcgattggttagggattcggggctaaagggccctccggaatgcgctactggctccatccctcgtaacggggcccggcaacatatggcgctccagaggactcaaggtacccgcacaggagttccccctgaggatcacgcgttccaccaacgaacctcagctacctcccacaccgcatcaacaaggggtatttccgctcagcggtgctttctttcatcgcagatcg

SEQ ID NO: 381410 - DNA, 2581 bp, Homo sapiens
gtatcctaacacatatggtttgaaaatatggttgctatatatatttcatacttagatgaatttggggcatacacttctatcccctttgattagaccaataaccttaaggtcttctgtgactttttcctccaacaggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccttttgtgtttttttttttttttttttgaagtcttgtataactaacagcatccccaaaacaaaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatataatatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttgtttacacagcttgtggaattatttcgtgggaaaataaatttttataacttctcccacttcaatttctaacc

SEQ ID NO: 381411 - DNA, 657 bp, Homo sapiens
ttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccctgtctctactaaaaagataaaaaattagccaggtgtggtggtgcacacctgcaatcccagctacttgggag

SEQ ID NO: 381412 - DNA, 414 bp, Homo sapiens
aaaccaccgctcccctaaacccagtgcaaacagtgtaacgtcaccccactccaaagagaaaagaatgcccttctttaagaaggtaacattaacttccaagctcccattgtccacctgctcaactgcactgcgtcacatttctagtcctgttgactgtctgcgtcctttgataagccaataacgtgcatgctctgttatttgtttcttttccatgctgctgtagctaagcagaagcagaaatcggtaagtttacattgacataagctgtgtttatcctgccactggcatcattagcattaattcccacagttgtattaaatacaatcatttctgtcccaagcaaagaacctatcaacagctaattgagttcatgcatttcaaaccaactaaattcagggagtgacctgttaaaac

SEQ ID NO: 381413 - DNA, 423 bp, Homo sapiens
aatgggaaaataagaatctccctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctcatgaaggccacctggatcaggcttctgaaaagagccaagggaggaaggctgaagaattctgatatctgtgtaagcgcaagggctttcgtttgtggggagaggttattttgtctctgcttttctgttgttgcagtgagtgcaggtagagagggtggtttgatttggttaatcggatcatgattgcaggagagggaagctagggagattcctctcattttttgagctc

SEQ ID NO: 381414 - DNA, 871 bp, Homo sapiens
ccacttgcgtttgttaattgactttgatgagctcctctgctctgcctaagtggttctggaacagagagctgttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctgggggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaagtaaggagaataatttcattttctaacagcatgatgtttcaccttgacataccatttcttatttcctattcatatgccgtttctgtgaagtagcattgcacatcgctgcagttgtataacacacataactaaatcaatggctctcaacctctgctaatataaatataccttttaaagtggaaagaagtcacaggcctcttgcaataacttcagcgctccctggggctctgtggcccagaaattgggaactgctagagtagatgatccttttttatgcttaacctatacttttttttaatgtttcaccttgactagg

SEQ ID NO: 381415 - DNA, 3489 bp, Homo sapiens
ccacttgcgtttgttaattgactttgatgagctcctctgctctgcctaagtggttctggaacagagagctgttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctgggggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccttttgtgtttttttttttttttttttgaagtcttgtataactaacagcatccccaaaacaaaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatataatatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttgtttacacagcttgtggaattatttcgtgggaaaataaatttttataacttctcccacttcaatttctaacc

SEQ ID NO: 381416 - DNA, 376 bp, Homo sapiens
caggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccc

SEQ ID NO: 381417 - DNA, 257 bp, Homo sapiens
  misc_feature (28)..(28): n is a, c, g, or t
  misc_feature (58)..(58): n is a, c, g, or t
aattttccttttcatgatgatgaaagtnttctgaaattagatagtggtgatggttgtncaactttgtaaatttctctttctataaatttgattactttagatatttcatatatgtgggattatacagtatcttctgtgactggcttatttcacttagcataatgtcttcaagattcattcttgtagtatgttatgggatttctgcctttttaaagactgcgtaacattccatcctatgtatataccacattttgctt

SEQ ID NO: 381418 - DNA, 827 bp, Homo sapiens
atggttgacagcacctgaattaaagaggtgaaagttaataccacagtagtgggaacatcaggcagcgctgataggatgcactgagaagaacacagtctcatttctgtagtattactgactaaactgcagaaacctgagtctacccatgaggaaacatcagtctcaaattgactgatattttgcttttagtattcaaacatactaatttcactgaggaaatggtccagattatttcagactatatagacatgagaatggaatatcacattggttcaggatgtctataaaaggataaggaaggttggcaaaatttgaagacagtccctcaagtagattatagtgttacgtgagtattaattgcctaagttatataattgcctgaggttatataacagaaaattcttgtttttaagaaattaaaacaatttaaaggataaagggataatgtcatagctgtaattttccaagcatttggataaaataatatacatgtttcaaaaaaaaaatgaaacagatgttgtaagatgttagcaaatagggaatccaggtggaaataatccaggaattatggatagtcttgtatctgttcagcaggtctgaaagtagttgatgaaaataatgcaaaagaacatgtcaaaaagaaatggtttgggcatatggcttcaagcatacataaatgctcaggaaacatgaaaatgtgaaataaatggatgagtactataataccagcaggccttgtagatacctgcatttgaagcatttatattagaaggaagcctttttacccagaatttttttcacttagcctaatgttttcaaggtttggc

SEQ ID NO: 381419 - DNA, 477 bp, Homo sapiens
ttaattctgattatttcccatctcactaataaacatgttcataaaacaaccaaaatacccctagacataagtctcatttcttactgcatgatatggtcagaaaataaaaaacaaaacaaaaacgaaacctcagttctttctagcttctgcctcctcctctcaccagcaaaacaaagccccaagcttgtgtacttctctgttgtctcatgttctgttcacttctccatacactataatgtcttctctcatcattcactaaaactgctcgctccaagatcatctggacttcttgctgctaaaaccatcatcttatagaatgttcaaaagtacttgacacttgtcaaattgctgtcttctgttggcttctatgacagtacgcaaagcctcagctgtttctccttaggctcctttgctgccttctcttcttctgccaaatggaaatgttccttacttttttttttttaaatgcatttgcca

SEQ ID NO: 381420 - DNA, 3647 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgta

SEQ ID NO: 381421 - DNA, 3626 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381422 - DNA, 658 bp, Homo sapiens
aagtaactttgttgctttaaatataagtgaaaatactgtatttacttttgtgtgcttccatctgaactaaagtttcccatggtgcttaccgagttaggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381423 - DNA, 608 bp, Homo sapiens
atgtaatataagtgtgcataaagataacaaaaaaaaaaaccgttgagtctgacctctgggcacagtttggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381424 - DNA, 547 bp, Homo sapiens
  misc_feature (46)..(46): n is a, c, g, or t
tcggtacccctcaacgctttatacttccaccctgaacgcgccgtcnccgcacctcaacgctttatacttcaggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaaagcgttgagctcaacgctttatacttcattatttctactaattcagtagttacgatcgtagcgccaaatttaaattcttccactggttcttctggaaggaattaaaacttttaca

SEQ ID NO: 381425 - DNA, 310 bp, Homo sapiens
ccacgcgtccgcataaatagtacaatatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgta

SEQ ID NO: 381426 - DNA, 202 bp, Homo sapiens
ctgttacaaagacttgaaatacgtattaacgtgcatttaatacgtatttcaagtctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381427 - DNA, 154 bp, Homo sapiens
gcggccgactactactactactgctcgaattcaagcttctaacgatgtacggggacatgtctgcatttgaattctctaaaccctaaatctgtgtctatgaaaaatacaaatgactattaaatattattctctttactgttctctttcaccgaaa

SEQ ID NO: 381428 - DNA, 3753 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgta

SEQ ID NO: 381429 - DNA, 2749 bp, Homo sapiens
  misc_feature (114)..(114): n is a, c, g, or t
ccgtcaatttctacgctctcaacaacccgcacagaaaaatcttcctgaacctcatggcttagcccaatatgtataagatataaacaatccttaataattgtttctgctctaaanggaatcattcgtgatgatcaacatattatgtgtagaacttgaagcgttcaactttgaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgta

SEQ ID NO: 381430 - DNA, 4968 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381431 - DNA, 5063 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgca

SEQ ID NO: 381432 - DNA, 3425 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381433 - DNA, 1928 bp, Homo sapiens
tgctagtagagctggttgtaatcggccgaggcaaagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgta

SEQ ID NO: 381434 - DNA, 3477 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381435 - DNA, 1954 bp, Homo sapiens
agcacataaatgccttaaaattaaaaatataagtccaaaattcaaaattcaatagatatgttagaagtataaagcgttgagctcaacgctttatacttcaggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381436 - DNA, 1965 bp, Homo sapiens
tgctctgtgttctagagatcccccttatattctggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381437 - DNA, 2374 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatctttggtactatttgtgaaagctgctgaacatccattgcatctatttcttctcctgagactgactggtcgacg

SEQ ID NO: 381438 - DNA, 1966 bp, Homo sapiens
ttagaggatccccgaaaagtggactcaagcgactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381439 - DNA, 1925 bp, Homo sapiens
  misc_feature (46)..(46): n is a, c, g, or t
tcggtacccctcaacgctttatacttccaccctgaacgcgccgtcnccgcacctcaacgctttatacttcaggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381440 - DNA, 603 bp, Homo sapiens
acgatctaaccacctcccaatccaaaaaacaaaaaaacctgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381441 - DNA, 1634 bp, Homo sapiens
  misc_feature (1585)..(1585): n is a, c, g, or t
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcacaagactacatcagggagctgnaggatgatgtaggggcgcgacacgcaggcgcagtaagtataagtcatgt

SEQ ID NO: 381442 - DNA, 556 bp, Homo sapiens
ggaaaatcttcagtttcttttgtggagaggagggaatttttctgtgatatgtgagtcaaccacagaattgtaatctacaccattgtacttgagaaatgtttgaatctcagtgttctattcagtatttcgcccaaatttttagcttaaaaatcatcttctcctgctttttctagcctcagtagaaattcagaacagctgtatttcttaaattaatataccaaaaattgctgtatactataaggaattggttaattcttagttttaagtattgctatttaattttttttttctgaaaaggaactgttaaaaagcttttaaatgtagttaagtataaacgctttttttgttaattgaagagatacataaaataaactgagtatagacttttgtaattttccagtcatgctcttatggttttttttttttaaagcctttgctgagagaactgtcatgtacaaaactgtgttgaattgctgtttgtttttactttcagtttaaaaatccccttattatgctgcttctggcttctgcagtcatcagtgttttaatgcatcag

SEQ ID NO: 381443 - DNA, 669 bp, Homo sapiens
gtagaacttaagcagaatgcctagaaacttctctgccttatatttgtgagcattgttcatatgtcagttttccaaaaagaaaatttattgtattctgaaattttaaatggcatgataaataggttgtaaatgtaacagttagatgtctgtatcatcaaaatgtataaatctttgtgatttatttaatagctcacatctcattgtttcctcttggtatctttttccaaaagtagaaggggtattgtgtagtcaaagaacagttaccaaaatattgttgaaactatcatgcagatgtaaaaattctttatttgttcctgttgtctaaacatcttgaaaatcctttgttaaaatactcttagctttaaaatgtccacgtgactgaagaatagtttacttgaaacagtcttcctttaaaagcatagtagtaagagatttttaaatgctaaaaaagtggtatcatagaatcaacagatttactctactgatatttttaaatgactctctttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaagg

SEQ ID NO: 381444 - DNA, 4900 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 381445 - DNA, 716 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttggatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccag

SEQ ID NO: 381446 - DNA, 5139 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaaaaaaaaaaaaaaaaaactgaaaatcaaaaaaaaaaagaaaaaaaaaaaaaataaacttacaagacataagtaaataacaggagaacactagaggataactgaaatataaaacctttggggggggcccggaacccaatttcctcttagggtggggtgaataaaattaaatgg

SEQ ID NO: 381447 - DNA, 5118 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcgcgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttcttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaaaaaaaaaaatacaaaatcaaaattaaagtaacaaaacacattaacacccaaaactattcacatatatcaacataatcacatatagtattaattaaacacttttttaattataattccttctggggggagtccggaatccaaattcccata

SEQ ID NO: 381448 - DNA, 3550 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 381449 - DNA, 1051 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactaggga

SEQ ID NO: 381450 - DNA, 466 bp, Homo sapiens
ctaatgtcactttctcagcaagactttccctcacccaacaatctggaggaggcctgttccctcccaccccagtcactatcacatcatcctttttcatttcttcagagcacatctcactgtaagaaatgatcttgtttacatgtatattatgtctccccagtttatctgaaaattcttatctgtcctgtttacactatatccccagtacataaaaatgtgccatatatatttttttgtttttttaaacagaaacatagcttacagtttttttgttttgttgtttaagcttacagtttttaaactttttatttggagataattatagactcacaggaatttgtaaaatagtacagaaaacagaagaacaatagagaaagtcaatgaaatcaaaagttggttctttgagaggattaacacattggcaaacctttagctaaactaaccaaaaaaagatgggggagaagat

SEQ ID NO: 381451 - DNA, 449 bp, Homo sapiens
tcccagcctgccagctcagctgtttctccctatagcgcatctctcagttatttctaggagttcttaaaggtgtgcatcgcatcatctcaaaaaccagcccgtccaacttgtgttatctgccctgttgatctacctttgttttcccaaggtctgcagcctccaaagcttctgaaatgggacttgctgctgctggtatctttagaggggcatgtggtatcctgccaagggtgattccttagcctgtcagtggcccagggctcaggattctacctgcctcacatctcctggatccatctgcatgtcttggcccaatctccatatcctcggttctggcccctccactacctggttgccactgatgattccaaggattcagatcagctcacagtgctccaaaaatatagcaaagtgaaacaaatgtgcaaataaatgataaaaacaaaagaaga

SEQ ID NO: 381452 - DNA, 464 bp, Homo sapiens
gcatcaaaatggaaaccaacaagtggaatctgctttttattaaaaaaaaaccataatcaagtaaaatttatgcaacaaatgaaaagattattcaaaattgagaaatctattaatgtgatttacaacattaacagattatagaagaaaaagctggccaggcacagtggctcatgcctgtaatcccagcactttgggaggccaaggtgggaggattgcttaagctcaggagttcaagaccagcctgggcaatctggcaagaccccatttctacagaaaaataaaaagaaattagctgggcatggtgatgaactcctatagtcccagctacttgggaagctgaggctggagggtctcttgagcacagaaggtcaaggctgcagtgagccgttgtgccactgcactccagcatgggtgacagaacaaaatactgtctcaaaaataacgtaaaatgaaataaaaataaa

SEQ ID NO: 381453 - DNA, 236 bp, Homo sapiens
ttttttcccactgatcacagggaaggagcaaccctgtgatatgtatgtttcctaattaaagcttaaatctagttccctgcaattgcacttctgaaatgttggaaccacagagtgaaatatttttaactttttccatccatcacattggtttttaggttgctagtaatgtcagccagaaaagtatctgaattgggaacatttttcttagagatttctacacttcttaaatgggtaag

SEQ ID NO: 381454 - DNA, 376 bp, Homo sapiens
gagtacagtggtgtgatctcagctcactgcaacctccgcctcccagttcaagtgactgtcctgcctcagcctcccaaggaggtgggattacaggtgtgcaccaccacgcccggctaatttttgtacttttagtagatggggtttcaccatgttggccgggctggtcttgaactcctaacatcaggcaatcctcccacctctgcctcccaaaatcccatgcctgggattacaggcatgagccaccccgcctggccaggattcacaatttgaacaaattctattttaagcttcatattttcctcagcatttaaaaaaaaaacatgtacagagaccatgtccagggcagcagctgcagccggacccccacgccaggcca

SEQ ID NO: 381455 - DNA, 248 bp, Homo sapiens
  misc_feature (1)..(2): n is a, c, g, or t
nngggggaggcccaaagattatgccatgaagaacttcaacattctggcacgatcaaaaaaaaaaaaaaaagtgaaaccttgggacgtactgattttaagtagaatcctagcaactgaaattatcaacttccttctgtgggtgaatgtgatgctaagcttgagcatagtaatgaattggttacccattcatttgctgtatagcatttactagtctaaaatttgggacagcaggcagagttcagggatgg

SEQ ID NO: 381456 - DNA, 362 bp, Homo sapiens
attggtgtggagcagtttcagcagtgggaggggtgaaagcccagctggagtgggctgtcaggagacttgggcggtaggcagaatgccccccaaaggtgtcacgcccttatgcctgcgcctgtaatattatgttacataacaaaagggactttgcagatgtaagtaggttaccaattagtgaccttaaaatagggagattatcctgtttatctgggtggacccaatctaatcacaggaacacttaaaggcataaagctttctccagctgaaggtgggagaaatgggacagaaaggatcaaagacgtgaagtagtagaaaggctggctttggccgggcacaatggctcacacctgtaatcccag

SEQ ID NO: 381457 - DNA, 352 bp, Homo sapiens
tccctccgtctagataagattctttaagaaaatcaatccagagcaaagccctgctcctttaagccctcactcaagtcagctaacacaagtccaatgctgataagccctttctgatacttctcactgagatgtactatggttccccatggtgtatattttccttaattgcaatgagcagtaaacccagcttgttcaactagagttggttcctgtggtccttgacttaagagcattgacaggacagtgggtcatcctcagagtcactctgatgggcagatgttatcccctccactcccatatacatatgccatgatatctagattactaagaaagcccattgtggcactgccaa

SEQ ID NO: 381458 - DNA, 1666 bp, Homo sapiens
tctcggccccccaaagtgctgggattacaggtgtgagccactgcgccgggcctggcaactcactttcaagctggctgggcttggctcctcacatttgtgcattctgaacacaggctgcagggacagctgctacccccagggaaagctcttttcgtggtgaagggagaagcataaaaaggcaagctgcattgtgcatatgcatatctgtgtctctccttatgttgtgtcatccaatatcccattggccaaagcacgtcacatagccaagctccaaatcaagggtcagagaagtaaatgatatctttttcctgaggggaactgcaacactacagggcaatggacacagccacagggaggggtgaagaattcaggtggacaatgcaatgaaccatgctgatgtttcctggagctgggatcttcaggagcctgtgcttggctgtgcccatccagtcaccaaggaggaacccccctactgcagagctgctttggggcctcgatgccattgttgccaaactgacattccatgatgaaaatggactgtaatttgtacagctatttgccagttgttttttctattttgcactgtggaaatctttgcccaaattactgcaagagtctcgagcatcctgctgtcgtaagtgcagagtcaaaggaagaaaacgatgattttttaaaccatctttctgctttctagtctcacctgagtgcctcacatttggcagaatcaacctggaatcctgctcataagactatcagggaaatataatttccagacttccatttccagaaaaatgtaataaatacttttaaaggggatggagatggtaccgtgtgctaaccccactctgagacaaacctgggtcacaggaaccatagggaagatgtctgcagtagaaggggacctcgaagtactcaagtacttggctcacaacagcactattcacataaagcctggcctgccccttggtgacctccttcccttacgcctctagactctactaggtgatcagaaatccctgcaagctagttggggagggaagagtgaaagtgaaaaatggagaggaaacactgctacccgcccaatgcctgaagccaaatgcaagcctgggccaggcttgggggaggaatcaagaggaagcttaaacttaaaatgaaatcgaaagtttagactcctacatgggattggacattttaaatgctgaacagagcctatttttatagctagaagttacaggacaaatttttggttaactgagaatgatccaaaaatcatgtgaattttgtgatccagaaagtcacagaacatgccctagattttatcccaggggcagggaggagtgacctgcagagcaagtttgaattggtaaatagaaaacaagaataaaatagtttgctgtttacattccataagcctggctctttcaacatcatgggtatatttcttggttgaatttagtatgccactatgactccggattgtgatatttgcctaggatgttttgtcctaatatttagtatggaattatttgcccaaatcacctgcccctctccacttgtagctttatttcaagaggtatgtttctcaaagtggagtgactgccagagtgggagaaaggagctagcccttacagctgtagtaggtctttgtacatcagcttggtaaatc

SEQ ID NO: 381459 - DNA, 1552 bp, Homo sapiens
gcatgctgatatgatagagaggcactcatcactaagcagagtagaatgtgatgcgacgtctcccgaccaacctgcttcgctagattttatgtaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctggggctcagccctgagctggcgtcacctgtgcagggcccgcatgctgatgtttcctggagctgggatcttcaggagcctgtgcttggctgtgcccatccagtcaccaaggaggaacccccctactgcagagctgctttggggcctcgatgccattgttgccaaactgacattccatgatgaaaatggactgtaatttgtacagctatttgccagttgttttttctattttgcactgtggaaatctttgcccaaattactgcaagagtctcgagcatcctgctgtcgtaagtgcagagtcaaaggaagaaaacgatgattttttaaaccatctttctgctttctagtctcacctgagtgcctcacatttggcagaatcaacctggaatcctgctcataagactatcagggaaatataatttccagacttccatttccagaaaaatgtaataaatacttttaaaggggatggagatggtaccgtgtgctaaccccactctgagacaaacctgggtcacaggaaccatagggaagatgtctgcagtagaaggggacctcgaagtactcaagtacttggctcacaacagcactattcacataaagcctggcctgccccttggtgacctccttcccttacgcctctagactctactaggtgatcagaaatccctgcaagctagttggggagggaagagtgaaagtgaaaaatggagaggaaacactgctacccgcccaatgcctgaagccaaatgcaagcctgggccaggcttgggggaggaatcaagaggaagcttaaacttaaaatgaaatcgaaagtttagactcctacatgggattggacattttaaatgctgaacagagcctatttttatagctagaagttacaggacaaatttttggttaactgagaatgatccaaaaatcatgtgaattttgtgatccagaaagtcacagaacatgccctagattttatcccaggggcagggaggagtgacctgcagagcaagtttgaattggtaaatagaaaacaagaataaaatagtttgctgtttacattccataagcctggctctttcaacatcatgggtatatttcttggttgaatttagtatgccactatgactccggattgtgatatttgcctaggatgttttgtcctaatatttagtatggaattatttgcccaaatcacctgcccctctccacttgtagctttatttcaagaggtatgtttctcaaagtggagtgactgccagagtgggagaaaggagctagcccttacagctgtagtaggtctttgtacatcagcttggtaaatc

SEQ ID NO: 381460 - DNA, 497 bp, Homo sapiens
tctcggccccccaaagtgctgggattacaggtgtgagccactgcgccgggcctggcaactcactttcaagctggctgggcttggctcctcacatttgtgcattctgaacacaggctgcagggacagctgctacccccagggaaagctcttttcgtggtgaagggagaagcataaaaaggcaagctgcattgtgcatatgcatatctgtgtctctccttatgttgtgtcatccaatatcccattggccaaagcacgtcacatagccaagctccaaatcaagggtcagagaagtaaatgatatctttttcctgaggggaactgcaacactacagggcaatggacacagccacagggaggggtgaagaacggcagcgagcgcaccaagtacacccagaatgaaagccagcgtgaaagagatccggaggaagcagagtcacaacagcatacataagcgaggacagacactaaccacagcgcgtagtacttgggcaacgtgc

SEQ ID NO: 381461 - DNA, 494 bp, Homo sapiens
gaaagcaggctcatttggggactgattccaagcagggttctgaagaaagagctagcccactgcgcagtggcccacctggagaggtagcagtctcctttcctgatgccagatccaagcagaggctaatgctggagaccagcgatgcccgtgggagaatccctgtagctagagggaattatctggaagtaatttatccctgtaccgccttgtggggttgggtgtttcttgcccactgcatgagttggtattactctaagagcgacagatacatgttttcacatgctttccatgtactagacactttctaggcatcagttctcaacatgacaaagagatccttctcagggaaatcagatccctcttccactgctgaaaaaccccacagtggctcccatttcacttggcataaacaccagtggccttgcagtggctgccaaggtcaaaccatctgcctttctgcttcctgctcacccttttccttcatcttctcatct

SEQ ID NO: 381462 - DNA, 783 bp, Homo sapiens
ggaggccaacatgtggaggatcgcttgagcccaggagttcgaggctgcagtgagctgtgatcacaccactgcactccagcctgggcaacagagcgagaccctgtcttaagaaaaaaagaaattcattaattcttccaaacctttataaagtaagaaaccactgaattactagaatagaaagtcagtctcctgagttaatttccacattgttgtctgtcttggagtcacaggttcattacccaagaaaactgccttttaatttttttagattactgttgatttcttaagtatgtaaatgactaacttttaaatataaggtaagttattttaaagaaatctactaagatagaagtcactttttttaaagtaaggaaattccttttgtatctcagtttatgttctcaaatacactactttataaaagtatacaattgactggatacttattcaccttgcccccatttcaagcgcctgttattgtcatatttattaaaaacagggtacctcataatggtgaaaatttctaaattattgggtctatatgtgccttagactgcctgattactttggctgttctcccagtgactgataataatagcatgatttgagtgttcatgtgagaatacatctaatattccttaagatctaagtaaataagttaaattctgatatgccacttatgtcaaaataattgttatatagatgaattattactgtaacatcatgaagtatcttaaaattatatgacttttggcctctcaaatgtcttacatgataataccc

SEQ ID NO: 381463 - DNA, 394 bp, Homo sapiens
gaatagttttgcaaaggaaaatatctttagcatgtgttgcctcagtctattcaaattttacaaccttgttactagttggacattatttttttcctgattgcccaaacaaatttcactgaaagccaataccaagatctgaacataagattataaaaaaagcaagaaataagaaaaatacaaattcacacaattacaatgagaaacctattctgagaataacagcttttgtaaaatttcccatttttattaaaatgttggttccaagaatggatttgtgttgtgccattttcagttcttgttactctcattgtcataatagggaatgagccaaaattgcaatgctttggatagtcttgtcacttggaatagtgtggagacctgctctgaccttctg

SEQ ID NO: 381464 - DNA, 356 bp, Homo sapiens
ctaatttaatcctcacaaaaactctacactagggttttttcctttttacagtaaaaacaacaacagcaacaacaaccacaacaacaaaaacccaaaaaaccaaaaacagagatttagaaactgccccaggacacacagctagtaaatgttggaaccagggtttgaacctagaccatctcattttttgctaccctatgaggaaagaaggataatttattataagagggttgttacagaatgaagggcagaaattcagaaggattacaggatgggctggaaccacaaagctgttgggaactcaggtcgtattctccctcagattcaactgtctgctttttagactagatgtggtatcc

SEQ ID NO: 381465 - DNA, 137 bp, Homo sapiens
cccctctgcttcctgaccaatcctggcacttccccaaaaggccctgtatggtgtggctgcctcctgctcttgggaactgatcaacaaggacctatctcacaggactggaaaaatacaccaaaagtatctgtcatgct

SEQ ID NO: 381466 - DNA, 447 bp, Homo sapiens
gagtgtcaagtgccctccagaagtgcccatgccaaaccagatgatggttccttattcctctacaattttctagtccttgttacaatattgaataatgcctgacaggcactctcatctccctgcaagggaaggtgagtgaagcaaaaataaaatgccaaccttagctcttctcagtatttaaatgcaatattatattatagtatcaatccattcattggtaatgaaatgacaaaaaacgtcacttcatttccccccatcaataatgacaacttttcttcttcccaaaaagctgtttcaggaggttttagtgggatgaataaatgtattcctttttaacacttttgttgtttaaaaatgctattgtttcatttgaggtgtgaggaaatgtgctaaccctgtcattgttggtgcagcagtgcagaaatgataactgtatatagttttttc

SEQ ID NO: 381467 - DNA, 419 bp, Homo sapiens
cagaattcaaccttatatagaaaatatagtgtttttagtgatttcattttgaaatattttgtacataaaaacaaaatgaaactattttgagtactttatgcctatacagactactagtaactgaacattcatataacgtagtatgttttgtaaaatgtttagcggttgcaaactggtttgccagatatgttttgtttagtaaaacttgagttgtaatcctttcaaagatggaagtaatatatagaaacggacgtttctgccctcttgaaaaagatgtggcaagagcaggcccacattttacatggcaacagttgataagggctaagctgtcttccccagatagatggaagaggacattgtccagcttgctgcaatccacacctgggtctctttattcagtcatgttctttgtactttct

SEQ ID NO: 381468 - DNA, 402 bp, Homo sapiens
ttttttgtatttttagtagagacgggatttcaccgtgttagccagaatggtctcgatctcctgacctcgtgatccgcccgtctcggcctcccaaagtgcgagaaagaggtgtttttgagtgagctggagcacggtgccactcctcagggctgtcgagtccctgcttgtgtgtgtgaaaaggcggtagaatgtggtggttaggagcacggacttttcttcaggcgctgccctcaactagctgtgtgaccttgggccagttatttcatctattcctcagtttcttcatctttaaaatgggaataataattccttcttcagaaggttactgtattaagttaaaatatctagagtgcttagaacaggacttgatgcatatttaactcattaaatattagctgctgc

SEQ ID NO: 381469 - DNA, 463 bp, Homo sapiens
  misc_feature (10)..(10): n is a, c, g, or t
  misc_feature (38)..(38): n is a, c, g, or t
  misc_feature (53)..(53): n is a, c, g, or t
  misc_feature (57)..(59): n is a, c, g, or t
  misc_feature (69)..(69): n is a, c, g, or t
  misc_feature (74)..(75): n is a, c, g, or t
  misc_feature (78)..(79): n is a, c, g, or t
  misc_feature (82)..(82): n is a, c, g, or t
aaaaaaattnatttataaatggagcccacactccgganaatggcaaaaaaaanagannncaaaaaaacnagaanntannggncagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381470 - DNA, 1272 bp, Homo sapiens
agcaacagcctcccgccgagccggccgggacagaggcggcccccacccccactgggcaggggactgcagacggcgctccccgactctcaagacgaccagggagcttcccttttcctcagcggggaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggtaagttgccagctgagacttgaatttagaaatcttcagcctcaatggagagattgaggactgaaaagaacagtgacctggctaactagaattctccaatatttgagttagaaggagccttacaccattcaattagtttagtggttcttgagtatcaaaggatccagagcagtcctgatgagatctaatcataacttaatggtttttgctgctgataaaaaaataaaagcaaaagtaatgtctttgttcatacgactgtgatgaaattcagccttattaatgagagcactatggttgcatttcactaattagcattttgattcctagggtaatacttgatatcactaatattatgatatcttttaatatttaagagtccctcttgagctcgtgtacttgagggaaagttcactttggttctgatcattagaacgtggaaatccaaagatgtgaaaggttgagttctgggttcccaaacatggcttaccttcagaatcatctagggaatttaaaaaaaaa

SEQ ID NO: 381471 - DNA, 366 bp, Homo sapiens
aaagaatactacataaaaaaagaagaataacatacacaaatctgttacgggaaatattaattatccctccaccaccacccagtagtcagctccttaccatcatttatttttgtaaagttgtgtgaataatttttaacccatttatcctgtttgtgcatagggtttttaagaaaaaacagcccagtgcaaagagcaacttcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381472 - DNA, 490 bp, Homo sapiens
tagtggtggcggaggcagtgaagaggatcccccctgcagacaccacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacatcgctacatgcggccg

SEQ ID NO: 381473 - DNA, 634 bp, Homo sapiens
  misc_feature (403)..(403): n is a, c, g, or t
  misc_feature (405)..(405): n is a, c, g, or t
tcaattaataaacagaaacaaagattctaggccaggcacagtggctcatgcctgtaatcccagcactttgggaggccaaggtgggcggatcacctgaagtcaggagtttgagaccagcctggtcaacacggtgaaaccccgtctctattaaaaatataaaaattagctgggcatggtgatgggcgcctgtaatcccagctactcgggaggctgaggcaggagaattgcttgaacctgggaagcagaggttgcagtgagccaagatcgtgccattgcactccagcctgggcaacagagcgagactccgtctcaaaaaaaataaagtagatgtttatgtccatgtgtttctttccacaggctttggatgaagagtatttaaagtagatgccaatttggaggcatngntcagagaaagatttcacctttgcagagaaggtgagtgtctgctctcctgtcttttttcacttgcacctcagaggtatgcagctgtgtttattgaactatgatgtgtcagtcccactagtcatagtgtatggtaatattctaccttgttttgcagatgagaacactgaggatagaagaatacgaagttcgtccttataatcacacagctagttactgagcgaggactagt

SEQ ID NO: 381474 - DNA, 347 bp, Homo sapiens
cagagtctggctctgttgcccagcctggtcttgaagtcctgggcttaagcaatcctcccgtctcagcctcccaaagtgctagaattacaggtgtgagctaccacacctggccaagactcagtaaattctatgtggaatgcatgaatggaaatacctaaaggaggcaaagctactactgctccctccccgctagtctaataattgagggagagaacagatgaaaatcaggtatgtcatgtctgaaaggttgccaacccagtattaaagaagttacaactcagtgtttagactctggggattctacactaaatcttacctaatctcagtgtcttaacgtggtgggatca

SEQ ID NO: 381475 - DNA, 2491 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381476 - DNA, 3500 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaagggtgtctggatgtgagctggaccatctcaggagagaacacaagtgtgaggcagctgctggcccctcacctagtctggggttcctttaccctgtaatggggggtggggggtagaagatggacaagacaccttaacagtccctttggcagtactaggcagaagaggcccatacttgggtccaatgtgtgcagcaggcaaaacattttcccttctaaatgtgggcccagaccactgccctgtcccccccacattaagaagcagtagccacagccaagtttcaatcatttaattaacatctttaaatgaaacacagttttcttcatgtgtctcactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctcccttctcctttgtcctctgtcccacccagcagggaaacaagctcagaagatcctaacaggatagagttccagtaatgttggaggagggagagggaaagagaagtcaggttctctcccacctccagccattcccaggttgctgccagggcctggtttcatgcagctttgacccagtcctggatcctagggggtggggtagatcaggagctctgagcagaacagtgctcactgattatcctctttccccaactcagtgggcaggtgcagcgtacacccagcagcactctccactgcccacaggcaagggaagaatattgattgattagctacaaggagaagacagtagtgactagtggaaaacaccctggagagggccagaggaacctggctctcaccacatcccctctgttcccagccttggtgagggggcggggaggtcatgtcaacctctctccttggtggtgaagcta

SEQ ID NO: 381477 - DNA, 3286 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaagggtgtctggatgtgagctggaccatctcaggagagaacacaagtgtgaggcagctgctggcccctcacctagtctggggttcctttaccctgtaatggggggtggggggtagaagatggacaagacaccttaacagtccctttggcagtactaggcagaagaggcccatacttgggtccaatgtgtgcagcaggcaaaacattttcccttctaaatgtgggcccagaccactgccctgtcccccccacattaagaagcagtagccacagccaagtttcaatcatttaattaacatctttaaatgaaacacagttttcttcatgtgtctcactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctcccttctcctttgtcctctgtcccacccagcagggaaacaagctcagaagatcctaacaggatagagttccagtaatgttggaggagggagagggaaagagaagtcaggttctctcccacctccagccattcccaggttgctgccagggcctggtttcatgcagctttgacccagtcctggatcctagggggtggggtagatcaggagctctgagcagaacagtgctcactgattatcctctttccccaactcagtgggcaggtgcagcgtacacccagcagcactctccactgcccacaggcaagggaagaatattgattgattagctacaaggagaagacagtagtgactagtggaaaacaccctggagagggccagaggaacctggctctcaccacatcccctctgttcccagccttggtgagggggcggggaggtcatgtcaacctctctccttggtggtgaagcta

SEQ ID NO: 381478 - DNA, 2484 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaagagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381479 - DNA, 2430 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381480 - DNA, 1969 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctcgcagaataacatcagcgctgtctgagtcagaatataacggggcgagc

SEQ ID NO: 381481 - DNA, 2043 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaagagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaattta

SEQ ID NO: 381482 - DNA, 1559 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagatcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381483 - DNA, 2388 bp, Homo sapiens
ggcgagaatgaagactattctcagcaatcagactgtcgacattccagaaaatgtcgacattactctgaagggacgcacagtaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381484 - DNA, 2341 bp, Homo sapiens
gtggcttagctgttattaactgtgccctggccttaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381485 - DNA, 1623 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagagtaaggccagctggagaggggccgacatcatcaggagagagagcttgtcaatgagccttggaaaaatgcctgtcttaaattgagggcacaacaacccagggggtctgaagtgcaggaatgtcatgtcctactggctcctagaatggaacttgagtcattttgatttgggtttggttaacatcaggaagtgatcacatccttttgtaccggcattgctgagagctgctggtgtaagatgtatactttggtccttctagtctgtttgttaaatctgcctcttcattaaagatagtgaccggggccagacacagtggctcacacctgtaatcttaacactttggaaggctgaggcaggcggatcacttgagcccaaaagttagagaccaaaacccagtctctaccca

SEQ ID NO: 381486 - DNA, 1418 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagactgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381487 - DNA, 2862 bp, Homo sapiens
gctagattttcttttatactttggtttagaaaggggaggaggagcctagctgaagcaatcttacagaagtaaaacaggcaaaaaagttagaaagacaaatggttacgggaaaacaaacagttccgggcgcaggggctttaaatccatcacaaggtgatagacgcggaggctttgggtaccatcaaccagacacaaatgctggggcttagggtaatatcaactgggcaaattcctgggaactgcggctatagctttccacaatatcttatcagttatttgcgttctttgatgtgctgggagtcagcttgcacaagttaagtccttgaggaaggggggtgggtaagaggctgcaaggggctacaagtgaaggagccaaaatggagtttgtctggctctctcagctaagggagagtcaattcagattaaaacaaggtagggtatcacatctgcactgagaacatggctggacctccttgatggctctgagcctggatctccactgacacatgctgttgttttccttgtcacatggtaaaggatgagcaaggtgaggcactgacattaaactaactcttctgcttccacaataggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381488 - DNA, 2300 bp, Homo sapiens
  misc_feature (11)..(11): n is a, c, g, or t
aaaaaaaaagnagggaaaagggaaaaagcgaaaacttaaggctaggtagcgaggcccgggtggttaaggaaggggctctggtgccgggctgagcgggggaagcaggggtagcggagccatgggggacgctcccagccctgaagagaaactgcaccttatcacccggaacctgcaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381489 - DNA, 2409 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381490 - DNA, 2238 bp, Homo sapiens
ctgatttctcagacccatatagaagaaataaagtagatgtttaggctgggcatggtggctctcgcctgtaatcccagcactttgggaggccaaggtgggtggccaaggtgagctcaggattttaaggccagcctgggcaacatggcaaaacgttgtctctactaaaaatacaaaaaattagccgggcgtggtggtgcatgtctgtaatcccaactactcgggaggctgaggcaggagactcacttgaacctgagaggcagaggtggcagtgagccgagatcacgccacagcactccagcctgggcgacagagcgagactctgtctcaaaaaaataaagtagatgtttatgttcatgtgtttctttccacaggctttggatgaagagtatttaaaagtagatgcccaatttggaggcattgatcagagaaagattttcacctttgcagagaagatgagaacactgaggatagaagataagaagtgtccaatatcacacaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381491 - DNA, 1357 bp, Homo sapiens
cagacgttaggctaggtacgaggccgggtgttaatcggccgaggctgctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381492 - DNA, 1212 bp, Homo sapiens
tcgagtcggaccactcggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381493 - DNA, 1625 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381494 - DNA, 1618 bp, Homo sapiens
aactataggctagtacgagctgggtgttaatcggcagaggcagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381495 - DNA, 1893 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaagggtgtctggatgtgagctggaccatctcaggagagaacacaagtgtgaggcagctgctggcccctcacctagtctggggttcctttaccctgtaatggggggtggggggtagaagatggacaagacaccttaacagtccctttggcagtactaggcagaagaggcccatacttgggtccaatgtgtgcagcaggcaaaacattttcccttctaaatgtgggcccagaccactgccctgtcccccccacattaagaagcagtagccacagccaagtttcaatcatttaattaacatctttaaatgaaacacagttttcttcatgtgtctcactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctcccttctcctttgtcctctgtcccacccagcagggaaacaagctcagaagatcctaacaggatagagttccagtaatgttggaggagggagagggaaagagaagtcaggttctctcccacctccagccattcccaggttgctgccagggcctggtttcatgcagctttgacccagtcctggatcctagggggtggggtagatcaggagctctgagcagaacagtgctcactgattatcctctttccccaactcagtgggcaggtgcagcgtacacccagcagcactctccactgcccacaggcaagggaagaatattgattgattagctacaaggagaagacagtagtgactagtggaaaacaccctggagagggccagaggaacctggctctcaccacatcccctctgttcccagccttggtgagggggcggggaggtcatgtcaacctctctccttggtggtgaagcta

SEQ ID NO: 381496 - DNA, 1571 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381497 - DNA, 1915 bp, Homo sapiens
gactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacaggtttagcatgatccatgcatgactcagcaaagtggattttgtctccacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381498 - DNA, 1372 bp, Homo sapiens
cgtgtgtgtgcatctgagcacacgtgtgcatgtatagttaaatcagcaaaaaggatctaattactcttctccatctcatttatttttatttttgtttttttagagacagggtcttgctctgtcaaccaggctggagtgcagtgacacaatcataactcactgcagccttgaactcctgggttcaagtgatcttcccatctcagcctcccgagtagctgggactacaggcacgtgcctccatgcccagctaattttttttattttagaaacagggtctgactttgttgccctggctggtctcaaactcctggactcaggcagtcctcacacctcgacctcccaaagcgctggggttataggcatgagccaccacgtccagcctccatctcatttgagtgttagattaaaatgttatttttgttaaaagtgagctctagttaactgttcacctatctttttgaaattcctaatcctgaacccatgaactgcttttaccaacaggtttagcatgatccatgcatgactcagcaaagtggattttgtctccacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381499 - DNA, 608 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctccagcctgggtgacagacagtgcaagactccatctcc

SEQ ID NO: 381500 - DNA, 702 bp, Homo sapiens
  misc_feature (17)..(17): n is a, c, g, or t
  misc_feature (21)..(21): n is a, c, g, or t
  misc_feature (329)..(330): n is a, c, g, or t
  misc_feature (339)..(340): n is a, c, g, or t
  misc_feature (342)..(342): n is a, c, g, or t
  misc_feature (344)..(345): n is a, c, g, or t
  misc_feature (350)..(350): n is a, c, g, or t
  misc_feature (355)..(355): n is a, c, g, or t
  misc_feature (357)..(357): n is a, c, g, or t
  misc_feature (362)..(362): n is a, c, g, or t
  misc_feature (403)..(403): n is a, c, g, or t
  misc_feature (405)..(405): n is a, c, g, or t
  misc_feature (409)..(410): n is a, c, g, or t
  misc_feature (418)..(418): n is a, c, g, or t
  misc_feature (479)..(479): n is a, c, g, or t
  misc_feature (500)..(500): n is a, c, g, or t
  misc_feature (516)..(516): n is a, c, g, or t
  misc_feature (530)..(530): n is a, c, g, or t
  misc_feature (539)..(539): n is a, c, g, or t
  misc_feature (558)..(558): n is a, c, g, or t
  misc_feature (603)..(603): n is a, c, g, or t
  misc_feature (614)..(614): n is a, c, g, or t
  misc_feature (616)..(616): n is a, c, g, or t
  misc_feature (625)..(625): n is a, c, g, or t
  misc_feature (694)..(694): n is a, c, g, or t
gggccgagtaagcggangtcngagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcagagtacacactagatgtgtacagactctcctccgtggtcacacagcacgattccaagaaggctggagctgaggtggtaaagcaggtggagcaccctttgctgagtggcctcttataccccggactgcccccnntccccctcnncncnnttctnacacncncaccnccccccttgtgggagggcattggatcagaagaaagatttcncncccnnctgccagnagaaggatgaagaaacacctggagggataggaaggataaagaaagtttggtcccaaatatncaccacaataacctcccctgncaacttggggctattncaaaaacgggggtnccattctgnatggaatccctatgggttnccagggatttaaacagggcaggcaaaaaatgtagcctctttcagnaaggagggagntnccaaggatntgaatctccctttggatcgggaaaggagggatgttgaaagaaaaaaaactgtaaagaagggcctttctngtggagcc

SEQ ID NO: 381501 - DNA, 416 bp, Homo sapiens
ggccaagactcagtaaattctatgtggaatgcatgaatggaaatacctaaaggaggcaaagctactactgctccctccccgctagtctaataattgagggagagaacagatgaaaatcaggtatgtcatgtctgaaaggttgccaacccagtattaaagaagttacaactcagtgtttagactctggggattctacactaaatcttacctaatctcagtgtcttaacgtggtgggatcagcagctgacctgccacagggaagaattctacctcatggggttcttctcattcccagagccaatggccaaaggccctgccaagaattcagaaccagaggaggtcatcccatcccggctggatatccgtgtggggaaaatcatcactgtggagaaggtactcatttttcaccacatctc

SEQ ID NO: 381502 - DNA, 890 bp, Homo sapiens
  misc_feature (842)..(842): n is a, c, g, or t
  misc_feature (871)..(871): n is a, c, g, or t
  misc_feature (877)..(877): n is a, c, g, or t
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatctatggtccaggattacagcacaaataantttagagagatcagatgttctgtcgaggngttganaaactacaagctt

SEQ ID NO: 381503 - DNA, 467 bp, Homo sapiens
agcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcgggtgatgctggcattgccattcctgccatggtcattggcattcctgtttatgttggaaggagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381504 - DNA, 2506 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381505 - DNA, 2065 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaattta

SEQ ID NO: 381506 - DNA, 2370 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagtgggccctagctggatctggtactggactagctaataaagtctcgcacaggaacggggattggaacggaggaggcacacccagacttggctacacggtggactccagtgtaccgggtgaggggcagcgtgccgactggatccgacagggggacccaaacggggcagagaagagagctctaaggggcaggaccgctatatgaaaaagcctcccgctttcttgagtgaaactatatacaaaagt

SEQ ID NO: 381507 - DNA, 2136 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggagggtctggtcctggggtaccggggctcgga

SEQ ID NO: 381508 - DNA, 2339 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381509 - DNA, 2050 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaacccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381510 - DNA, 1861 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgcttaaccccacgccactggcgcggctagactaatgcc

SEQ ID NO: 381511 - DNA, 2364 bp, Homo sapiens
aaactatagggctaggtacgaggccgggtggttgcatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381512 - DNA, 2390 bp, Homo sapiens
ccggggtctttacgttgtatttagctggtccgttcggttttacaattttacaagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381513 - DNA, 1885 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagactcaggcttcagggcagagggaatggatttttagacatatcaaagactcaaaaatttaaagaaatatatatatgtatatatatacttctaacattttatggaaattaaaaatcagaggcttttggtctctccatttactctaggtcaagctcatttaccccagaggacaaagaagggctgcctcttctagaccctcccttctcctttgtcctctgtcccacccagcagggaaacaagctcagaagatcctaacaggatagagttccagtaatgttggaggagggagagggaaagagaagtcaggttctctcccacctccagccattcccaggttgctgccagggcctggtttcatgcagctttgacccagtcctggatcctagggggtggggtagatcaggagctctgagcagaacagtgctcactgattatcctctttccccaactcagtgggcaggtgcagcgtacacccagcagcactctccactgcccacaggcaagggaagaatattgattgattagctacaaggagaagacagtagtgactagtggaaaacaccctggagagggccagaggaacctggctctcaccacatcccctctgttcccagccttggtgagggggcggggaggtcatgtcaacctctctccttggtggtgaagcta

SEQ ID NO: 381514 - DNA, 2273 bp, Homo sapiens
  misc_feature (13)..(13): n is a, c, g, or t
ctgtcagtacccncgattatgtacgaggctgggtggcgcaggaaggggctctggtgccgggctgagcgggggaagcaggggtagcggagccatgggggacgctcccagccctgaagagaaactgcaccttatcacccggaacctgcaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381515 - DNA, 2145 bp, Homo sapiens
  misc_feature (17)..(17): n is a, c, g, or t
  misc_feature (21)..(21): n is a, c, g, or t
gggccgagtaagcggangtcngagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381516 - DNA, 1754 bp, Homo sapiens
gacatgttgaactagaggaatacaacaaaatagatataagccacaagccttcccctgaagcagctgagatgctagctgggtatacaatagtgccactcatccaatttaagaataataccatacaataaagttcagaatatatggcaaaaactacaaatagtcatgcatgtgggctaggaatagtcatgcatgtgagctaggaatgctgtcaatgagtttgttgacatggatccttttccttatagagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381517 - DNA, 1171 bp, Homo sapiens
actctgaggatccctgttgactacggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 381518 - DNA, 1380 bp, Homo sapiens
gctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggtaagttgccagctgagacttgaatttagaaatcttcagcctcaatggagagattgaggactgaaaagaacagtgacctggctaactagaattctccaatatttgagttagaaggagccttacaccattcaattagtttagtggttcttgagtatcaaaggatccagagcagtcctgatgagatctaatcataacttaatggtttttgctgctgataaaaaaataaaagcaaaagtaatgtctttgttcatacgactgtgatgaaattcagccttattaatgagagcactatggttgcatttcactaattagcattttgattcctagggtaatacttgatatcactaatattatgatatcttttaatatttaagagtccctcttgagctcgtgtacttgagggaaagttcactttggttctgatcattagaacgtggaaatccaaagatgtgaaaggttgagttctgggttcccaaacatggcttaccttcagaatcatctagggaatttaaaaaaaaa

SEQ ID NO: 381519 - DNA, 1675 bp, Homo sapiens
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggttagaagttcaagccgatgtccaaaaggaaattttccccaaagacacagccagtcttggtgcaattagtgacaacgcaagcactcgtgctatggccggttccataatcagttcctacaacccacaggacaggtttagcatgatccatgcatgactcagcaaagtggattttgtctccacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381520 - DNA, 1865 bp, Homo sapiens
gactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381521 - DNA, 904 bp, Homo sapiens
  misc_feature (673)..(673): n is a, c, g, or t
  misc_feature (675)..(675): n is a, c, g, or t
aaaaaaaaaaaaaaaaaaaaaaaaaagagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggctttggatgaagagtatttaaagtagatgccaatttggaggcatngntcagagaaagatttcacctttgcagagaaggtgagtgtctgctctcctgtcttttttcacttgcacctcagaggtatgcagctgtgtttattgaactatgatgtgtcagtcccactagtcatagtgtatggtaatattctaccttgttttgcagatgagaacactgaggatagaagaatacgaagttcgtccttataatcacacagctagttactgagcgaggactagt

SEQ ID NO: 381522 - DNA, 1595 bp, Homo sapiens
gactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttcagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaaaaa

SEQ ID NO: 381523 - DNA, 440 bp, Homo sapiens
gttacatgtgaaaatatctatatccaagggctgggatggacccaaccctcacagcatttctcagtgactttgtggggcattaagacaagtagagccacaagagtcaatttgtttttgctattttgatttaagatacatcgaagcaaattggaatgtggttataatggagcaagttaatactataatgataaaatataatcttcttgaggaaaaggacaaagataaatgaaaagatcattggatgagtcatcagaaaaccaggatcctaggcctgaactgtcatagatctgtgattttatgacactggttgcttgggtactctttcttagcctgactttcctcatttatgaaatgaaaagctgaagtagattacttttctttaaatctcttttaacacaaatattcaacgatttcatgggaaccaacatactcttcactaa

SEQ ID NO: 381524 - DNA, 370 bp, Homo sapiens
gatcagtgagaggcccaggcccctgaggagcctgggctaggtcagtagatgcagtcctctgccatcttacctaaagttttcatcccaaggcccccatcctacatcccgacgcagaccccttctctgttcccctcacaccactgcagcccaggggctccagctcgtcctctctgccccgtccacctgaccaccctcctaaccatgcagacttccctcagcaccccatgtgcccttcccaggctgccctgcaccccatgccccttgggccctggtgcatcttcatgcagcaactatgggcccccagctagagcctcagccccttcttctgtccatcccatggtcctgggctctgggggccattctggccact

SEQ ID NO: 381525 - DNA, 316 bp, Homo sapiens
atctagtctgataatctctcctttaattgatgtgtttagatcagggttggcaaactatggctggcaggttaaatctggcctgccacctgtttatgtaaataaaattttattggaacacagccatgcccccatgccaaccagtggtttagaccatttgcacttaatgtaattttgatatagttgaatgaaactgtgccatcttactatttgttttctgttggctggtgttgtttcttttttccttgattatctgcctgtttttggatggattattttttatgattctattttatctttcctgttggtttgtaactta

SEQ ID NO: 381526 - DNA, 574 bp, Homo sapiens
  misc_feature (574)..(574): n is a, c, g, or t
catgcctcatcctcccaagtaggtgggattacaggtgcccaccaccaagccctgcaaatttttttgtatttttagtagagacagtgttttaccatgttggccaggctggtctcgaactcctgacatcaggtgatccacctgcctcggcctcccaaagtgctgggattacaggtgtgagccaccacgccctgcctactctttgttttctttcctccccacccattttcccccgtcctgtcccctccttccagcctgagatgtaggctccaccttaactgtgctcagatacacaagtgagggctttttaacttgattatgccttttaaaaatactatgtatgtaaaatatttattcatctgcaatttggcttccctaacttaacattgcatcatgaaactctttggaacaacagctatctagatagctgactcattcttttggattgctacgtaatctcacttaatacagatgtatcatgattgattgaatcattgccttgttgatgggccttcagattatttccagttttttgccactgcaaacaataaacatccttgtacatactaaaaaaaan

SEQ ID NO: 381527 - DNA, 2105 bp, Homo sapiens
cagttgttgtcaactttttattattacatatagcacatagtgggaatatttggttgaaagtaaattagaaataaaaaagggggaaagtaggaagaaaaatcccctcctccaggtctgaaaatcagacaaaaatccttaaaacttgtagccttgccatgctacaccacatctgccaatacatgaaactgacccattagtgctctgctggatcagcctgcccaggcactgctgcctgctggggctgctgtcatcctctggccgctcctccaaagagggacaatgggttttactcagggctaccactgttgctcctgactggggccaccatggtgcccaggcttcaggcacagggccctgcctccttccccgcaccgccctccaggtggtccacctcgtggctgtcagttcctgttggacctggagctgctccggcttcctgtgtgtggtaggggagcttcagtgtgctatgctcttaagagagcggccctcagagctactgagggaccccagacacacatggtgtgaccagtatggaggaggccaggatgctcttcctctcttaatgcaagctggggcggcggcagccttgttcaggtcttggcaccttgtctcaatggatcaccttgagatggctgccgaccaaaacccttgtcttcctgtcatacggatggccaattacatttattcagtgtacaaactatacataaagctctctagaagctacagaattaccatttcttgtgtatcatcttagaacttttatacagatgagatcatcctttccaaatgtttttgccctgatctgcctctttctaataactatcaagtgtcacacaatagggtccccctaagggtcacagaggcttccagggttttggttcctatcaagaacaatgctgcagtgaacattcttaaacacatctttgagcacatgtgtgtacacatccctatgacaaattccccgagtcagatgggtgagtcaagggaatcaagtgcaatctatttggaacctccctgtggcacctcatgtttattcttgtattggtcttgtcctgttttagttggtcgaggactaattctgagaacttgctaattctgctttctaacttatcatctgtaattgcaatcagcttcttgtatttgtcctcatctgtgttacagaccgagctgagcacagagccctaggacctgtcactgtcactagagacctcccttcagcttccagaaccacttggagggaccaggaagtctgtgactgtgccacgtggcaccatgaagtccccatcctcctggacccaaatgcctggtatgaacttgcctttgctgaggtcccccagacttcagagctgctgcctgcaaggggcctgctgagtctactcccaggcactacgcctaactgtcctccttgaagcgccaccctctatgccatgcgcctagccctcccaagatgggctaggagaggactcctgcttcccccgctcctcctctggctgatccctggggaaaacacacatggacacttagggacaggagcatcagtgctgcccacctgacccccagggagcaggaggcttcagcccgcccccatctgctgctgagggctcaggtagccatttctctcataagccttgacagctggggatgtgcttccagtcttttgctcagctgcaggggttaccagggaagtggaggcaggagaggcaggagggctcaggggcaacaagcagacaatcgggggagtcaggcagacctgggttcaatcccagctccactgctcactaatgtgggaccttaaatgtgtgtctgcccctttctgagcctcaggaccctcagcataaaacggagacagtaagagaatctacctcacagggatgttgagagaattcagccaattcctgcatgggaaacatttcgcataacacccttcgtgggacggctgggggcgaccaggggagggggccataccatgagccaggccagagagggcctatgtcaagacagatcctgctggctcaaacacactgagaagctagggaccccctttcaccagcagctttgcgtggtccatggctggctgtcagtaagttagctattttttttttttt

SEQ ID NO: 381528 - DNA, 400 bp, Homo sapiens
ctcggggaagggctctgggccccacctgaggaacagagcagatgttgcttgcaagtggcttcctgtttcatggagcatttccgcctgtaaaatggcatctgaaaagaccgagctgagcacagagccctaggacctgtcactgtcactagagacctcccttcagcttccagaaccacttggagggaccaggaagtctgtgactgtgccacgtggcaccatgaagtccccatcctcctggacccaaatgcctgttcacagacctcttgaattccatccatggaccctggccaccccttgtgtcacatttccttaagaaaccactgctaatccggtccagactgttgagggaggaagaaactcaaatggtatccaaactcaggacacactgccacatgtgtgc

SEQ ID NO: 381529 - DNA, 558 bp, Homo sapiens
cccattcctaattttataaaccacattcaaacctgttaattcgctgttatcattctcattttgccatttagattttaaaatgaagagcagtgttttgttagaaaaaacaaaatgtttaccataacaagaaagatgtgtagacaagaaagatatttatgtagactctttgtttgttaaattttgaagccaggtgatgcattgttagctttgacaactgacttaaatttttgtataattatttatctttgcattttgctcaggtaaattatcttcccagagtctagaaataaagatatccctgatcctgtttaagagcataaataatactctcaatgtaaattgttttgaaataagatcttaaaaatacaaaatgtagacaattaatattcaggtgcttacttttgagccaatatgtagcagagaaaaactaatttctctgtggcagtatttttatttttggcatttcccaggaattaactgaagactaaaactcatatgtgaagtgtaatgatactaatcaaagagtcagtaaaatttccatttggctaccatgtatgt

SEQ ID NO: 381530 - DNA, 616 bp, Homo sapiens
atcattgctagaagctgactaattatgagaagagaagtgaaggccttgaaatgcctctctctgcacatctggcctcactgtcaaataaagtacttatttctgataagctctttggcttctgtgaagccgcctggccgtgtctggccgtgggcggtgctgataatgaaccgaacagagaacacagacttggcggggaaggtggggacccagtgggtagaaagaatgggctttttagaccatttcaaagtaacaagaaagctttgagagtgcttagtgatgtctgctaccacattcatttcctctgtttccattgaaattgaagttctagatggactgaacctgactaagaaaagggaatgtggacaggaaagctaatgacaaatgcaactggcttatttctggagtgctttgtactctcagagtcttgtgccctgaactttcttcatctggactctaggggcacttaagcaattagcatgccacaagctgggtgctgtggaaagatcatagactttagaaactgtccaagaaactagtgggactccacaccttgtgagttgtgtatccttgtcaagtttaatttaccatgttgagcctcagtttcctcacctaagag

SEQ ID NO: 381531 - DNA, 1209 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggagacaaggtttctccatgttgcccaggctggtcttgaactcctggactcaagtgatcctcccatctcagccgcccaacatgctgggattacaggtgcccaggccccacaagtggccccagcccaggaacgaatctctcaggctgcatcaggatgaatgatgacccaagtatggaacagagactggtgttgaacgcgtgtgtcctgagagcctgttgcatccaggaatattcctcataccattaccagaacacattcatcgcaaaggtacttacttcagtgactggatacacttcggattg

SEQ ID NO: 381532 - DNA, 2890 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381533 - DNA, 2711 bp, Homo sapiens
tatattggcagttattgagggtaaagcaatatattgtaacagaatgtataaatatttttgataaaacagtctatattttattaaaaaatgaattataacccattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttcaaaaggagcaaagaagaaaagaagaagaagagaagagaggggaaaaaaaaggaaaaagcagaagaaaaccggaagagaaggaagaaggagaaaagagggagaagggagaggaggaggggagagaaggaagaaggggagaggagaggacggaggaggagagaggagagaaaggagtaaaaaagataacaaaagagg

SEQ ID NO: 381534 - DNA, 2980 bp, Homo sapiens
tatattggcagttattgagggtaaagcaatatattgtaacagaatgtataaatatttttgataaaacagtctatattttattaaaaaatgaattataacccattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttcatagagtgaaagctgaaattcttaacaggccaagtattcaaaggaaaaaaaaatactgtttttaaaataaaacttgagtagaaaatgcagattagaaaatttttaatagttgatttgaaatgtattcattcactcattacattgtgttgcagaaatacctgtctttcaccatgcttggttcttcatacttacaatacagtttgtaagtggaggttaggagtagctgagcaatctggtagagagcagcatgtggcacacagagttgacaaactgacagttggaactcctgactttctccattgcttcctcagaagcaaaatccttcaccatgtgatataaagtagaatgaaactcagtttcttctttaagtgcttcagaaaatgcctcactctcttccttgatcttcagtctttgtgctctgtcaccactaaacattaaaagggcccaattaggattctcagtac

SEQ ID NO: 381535 - DNA, 3083 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtggtaagtggatttggaaataatattaaaatagactgttagtattacagctttcagcctgatgttctgtgacctgctggggtgtgagcaaatgagaagaacataggcaaatactccttttgcatagtatagttaaatacactatatataatattatgtgcatagtattcgcaccatttgtttctcctgttgacagatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381536 - DNA, 2952 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381537 - DNA, 2788 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttgaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381538 - DNA, 2742 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctgggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381539 - DNA, 2809 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381540 - DNA, 1792 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381541 - DNA, 1686 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtggtaagtggatttggaaataatattaaaatagactgttagtattacagctttcagcctgatgttctgtgacctgctggggtgtgagcaaatgagaagaacataggcaaatactccttttgcatagtatagttaaatacactatatataatattatgtgcatagtattcgcaccatttgtttctcctgttgacagatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggtaaggaaatacgtatgttcacaacaaaggtggtggtatcttacaatggtagaactatccctc

SEQ ID NO: 381542 - DNA, 1969 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagagtgagtagcaaatattcatttatgacccagtttttgtccaccctcaggcggggcataggactacagacatttttctagattacagctaggatattattcctgagtttatgacaatgaaatggtttgagaaggcaatattgtggggctttcagagaggtttgctgagtggctaggtgcatgcatgggtttaaccattaacttccctttttgcctttttattataagctggttttgtctgtggctgtttttttcttttaaaattaattaaaacttctcaaaatttctaaaagtaaacaaggagaaaaatctagtatgcatggtatatttgaacttgcaagttgttatatattatactctgattttattagctagtttttttcctctcatatggtagaaaaggccttgctcgtctattttctttggaaattttagggggttgggcaaaataattatgaattcagtgtatatcaaaatatcaaatgtgtgaaaattcttttaaagttttaatgcattctctacatacatctacatacatattttgcattttaaaaattggaatatttgtcatttttctgtattacccaaaagtatataaacagttaccagagatttatgtgagaagacagttgtcacattacagatgtcagattagctataaaattgtttcattctagaaacctaatatggtaaaaataaaccttacttatttagccatttatcagacaattgcttttgttcagccagtttcttgttctagcagtataaatattctttttatagaaagttacttggtttgagaaataaacattgtttatttgttaattgttatataattataaataattatatatttaatatataagcttaaggtaggctagagatgaaaaatttcagacttgtgtttgttttggatttattgtaccctttctactattatctgagaaagctatttaggagtttaagaaatagtctagttttaaaatagcaatggtttgccggacacagtggctcacccctgtaatcccagcattttgggaggccgaggtgggcagattgcttgagcccaggagtttgagaccagcctggacaacatggtgaaaccctgtctctacaaaaattacaaacaaataaataaataaaacattaaaatagcagtggttattcaacatattattgtcataatttttaaacctttattgaatttgccagttttcaatattctgattcactctgttaag

SEQ ID NO: 381543 - DNA, 1902 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggagacaaggtttctccatgttgcccaggctggtcttgaactcctggactcaagtgatcctcccatctcagccgcccaacatgctgggattacaggtgtgagccactgtgccaggtgacaaagtctattttaaaggatacaaatgaacagccagatgaagagatacatcggaaaggtttggaaatgtctcgagcacaggagggtctgtctttgtggagttggggtgtgccatcttcccagcacatggctatgttttagttcaccaaatcagaagctttccaagtgctgtcctttcaggtttttatggaggctttactaggcacgattgattaaatcattggccattggtgatcacctcagccccctcccctcccaggagcttggcagggtggagttgaaagttccaacgctcaaaccacagattggttcccctggcaaccagcccctcatcctgaggctatccagaagcccaccaagagataccgcgttagaacagaagatgctcgtaatactcaggaaatttcaagagattcaggagcttcgcgtcaaacactcctatcactcgggaaattacaaggtcttagacactccgtatcaggaaccaggatcagagaccaaatattagagtaaagattcccctagcacctctgtctacaaggattttaggaggtctgtctcaggaactgggggcattgatcacaatatcaacgacatcctcctaagttaacttagacaggttttgatcctatttctgtttctttcacactcaaggttaacaagcctttgggaacctatacctgtccctgccctcatcctccttcggtgctcatttgcacctgcctttttaagtatacagactcatcttccttaggaaacattaaaaaatgtcagtgcattttgtgagggcctaatctacctcaataaaatttcccttctgtattgagggtgaggaaggatggctttgaattgcaaatgcttcattttcatttttgact

SEQ ID NO: 381544 - DNA, 1821 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaaagcagtgttgccacaaactatatggtggtcaagaagcaagaatacatcagacacccctgaccttgaaacatacgtgctggtacacacctctgctggagacaaggtttctccatgttgcccaggctggtcttgaactcctggactcaagtgatcctcccatctcagccgcccaacatgctgggattacaggtgtgagccactgtgccaggtgacaaagtctattttaaaggatacaaatgaacagccagatgaagagatacatcggaaaggtttggaaatgtctcgagcacaggagggtctgtctttgtggagttggggtgtgccatcttcccagcacatggctatgttttagttcaccaaatcagaagctttccaagtgctgtcctttcaggtttttatggaggctttactaggcacgattgattaaatcattggccattggtgatcacctcagccccctcccctcccaggagcttggcagggtggagttgaaagttccaacgctcaaaccacagattggttcccctggcaaccagcccctcatcctgaggctatccagaagcccaccaagagataccgcgttagaacagaagatgctcgtaatactcaggaaatttcaagagattcaggagcttcgcgtcaaacactcctatcactcgggaaattacaaggtcttagacactccgtatcaggaaccaggatcagagaccaaatattagagtaaagattcccctagcacctctgtctacaaggattttaggaggtctgtctcaggaactgggggcattgatcacaatatcaacgacatcctcctaagttaacttagacaggttttgatcctatttctgtttctttcacactcaaggttaacaagcctttgggaacctatacctgtccctgccctcatcctccttcggtgctcatttgcacctgcctttttaagtatacagactcatcttccttaggaaacattaaaaaatgtcagtgcattttgtgagggcctaatctacctcaataaaatttcccttctgtattgagggtgaggaaggatggctttgaattgcaaatgcttcattttcatttttgact

SEQ ID NO: 381545 - DNA, 312 bp, Homo sapiens
gagttagatatttatcgactttccctaaaacagaacaaatatttgtgagcctcttgagttacagtaagattcagcaatattttatgaataattatagcatattatccttagtttcaaatattaaaaacaacatttatttacagaactaaagatgactcagagccatctggagaagaaacagtagaaaggacaaggaagccaagtctttctgaaaagaaaaataatccatcaaagtgggatgtctcttcagtgtaagttatctacttgataaattctaccattttagtggaatgggaaagggtgaggcagggc

SEQ ID NO: 381546 - DNA, 511 bp, Homo sapiens
tcacttcatgttttggcacaagctctcatatgctcggtgtctgtttggcttggctgtgactcagtgcaggtgaaccctgtgcatgtcagcattatgttgctggggggagaaagaaatgcctcagtataaaacagtattaaactgaaacatctgaccacatccggttttctctcctcttcctcaccctcacattattttgacaacaggcagaatttctcagattatctttgggatttaagtgtgactggtttaccttggagaagagagtgaagcttgaagagaggtcccgtgacttggcagaagaaaatttgaagaaagaaatcactaactctttaaaactattagaggtgagaatcagaacatttgggatataaacatttggtctagccaggcacagtggctcacacctataatccctgcactttgggaggccaaggcaggaggatcatgggagaccaaggcaggaggatcacttgaggcccggagttcaagatcatcctgggcaacatag

SEQ ID NO: 381547 - DNA, 682 bp, Homo sapiens
ccaacattgagttaggtggaatataaattggtaaaatatttctggaagacaatttggccacaagaggatcctttaagatatgtctgtttaactcagctgtggtcaagtacacggatatgcatgtacaaggatatttattggtgttgcatataatgataaattattgagagttttctaaatgtacattttcctccttctggtagccatcttctctacgaagagtgactattgcctctttacccagaaatattggaaatgcaggaatggtaagacaattcctaagtgttcttagtcaaaggtaaattcattttcatatgacagaaaatataaacgtatattttatcatttcttttaacatttgaacttctactaaaggtggctgggatggaaaataatgatcgattcagtagaaggtcaagcagttggtaagtgtaattttatggttcctctttgggaaccttactattttatacttgggctaacctaaatgagtgctcaaattaagtgatatagtaatgtttgatttgtacaaagtgtaaacagaataattatataaattggtatctaattatgaagttttttatcataaagtaggagatctgtgaatgtgccaagaaaaaaataattaggacatataattttgtatttacttaagcagtaggaaataaattgataatggcta

SEQ ID NO: 381548 - DNA, 2517 bp, Homo sapiens
tatattggcagttattgagggtaaagcaatatattgtaacagaatgtataaatatttttgataaaacagtctatattttattaaaaaatgaattataacccattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381549 - DNA, 2854 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381550 - DNA, 2897 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggagacaaggtttctccatgttgcccaggctggtcttgaactcctggactcaagtgatcctcccatctcagccgcccaacatgctgggattacaggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381551 - DNA, 1610 bp, Homo sapiens
ggaaactggtccctggtaccaaaaaggttggggactgctgttatagagtgtttttgtcagagtaggcttaggagaggacaggaagtaggaaaatgactggttatgaagtatttccactctatgtacagtggtaaaatcttatgattttaggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttca

SEQ ID NO: 381552 - DNA, 2113 bp, Homo sapiens
taactccagtcagaaacaactagaagccattaaacaactacaggaagatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaacgttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactctttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaaggtaattactaattcacttaacaaatgtctagcaaatactataagacggttttaaaatgttatttg

SEQ ID NO: 381553 - DNA, 2565 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccatttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgtctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtggtctgctc

SEQ ID NO: 381554 - DNA, 2404 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcgggtcagtgtggccgggggccgggacgaggggaccccggactgggggaagccgggaccggggacctggggccgccggcgcgttcctttcttccagcgctggctgctgcggatgaaggggtcgccggaacgtgggtgggggcctcgggctggagaggcccaggacgttggagccccaggataagcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgaaaaaaaaaaaaaaaactggggcattatgtcggggggaaaagggttttacatgggcctggttaagtgtttcggaaccatttttgtaaaagggaaattgggggccaaggggggataatggaaagagtac

SEQ ID NO: 381555 - DNA, 2096 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacga

SEQ ID NO: 381556 - DNA, 1965 bp, Homo sapiens
gctcggaacccccgggcagggctcggggaaggacagagcagagacatccagagcgtggcgtcacctggctgggccggatccccagcttcagtcctggggattcctattggtccgtcatgcacttatccggtcttgggcacgggaagaccaatggtatcctctggttgaagcccctgggcccttgcagaaggcgctgtatttctccctttaactcagccctgggggtcttgggttcggctgccattggggcgcacaattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgaaaaaaaaaaaaaaaactggggcattatgtcggggggaaaagggttttacatgggcctggttaagtgtttcggaaccatttttgtaaaagggaaattgggggccaaggggggataatggaaagagtac

SEQ ID NO: 381557 - DNA, 1265 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgaggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacga

SEQ ID NO: 381558 - DNA, 2223 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcgtggacgatgtggccagtaccctgaaggacaggacagtgaggaaggggagggagaggctggggaggggcaggcagggcgacaggcagggtctcagcggtagggacactgagggccaggcctagtggctggtgtggcgggagtggcgagccagggccctgtgggtggtgaggagtagttgctggccagcctggatgacgacctctgacccatgtcgccactggagctggtggcagtggggctggggaggaaggaacgccaagggccacagagagaacccaggctccatctgggccgagacatcctggcctctgagtttgacaggggagcccactgcccggccaaacaggagctggggctgggagctcagactcagtccagcccaggtgggagtcctggggaaggagatagcccacgagcctcaccagccctgggtgacagccagatggtgtccgaagccccaggcctggggcaggcagggggtgtctgggccagggatgaacggaggccaaactgggtaacaagcagagtcgggtgtgcagtgtctcataggcaacgtgaggagtgtttgagcaggagccggggcaggaggttgtggaaggccctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacgaaaaaaaaaaaaaaaactggggcattatgtcggggggaaaagggttttacatgggcctggttaagtgtttcggaaccatttttgtaaaagggaaattgggggccaaggggggataatggaaagagtac

SEQ ID NO: 381559 - DNA, 2827 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcgggtcagtgtggccgggggccgggacgaggggaccccggactgggggaagccgggaccggggacctggggccgccggcgcgttcctttcttccagcgctggctgctgcggatgaaggggtcgccggaacgtgggtgggggcctcgggctggagaggcccaggacgttggagccccaggataaggtctctcgggccgccgcgcgcccccttcagacagtgctgcgtgggggaaccgggtagatgcgggggtgtggccgggctgggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccatttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgtctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtggtctgctc

SEQ ID NO: 381560 - DNA, 2424 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccatttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgtctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcggcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtggtctgctc

SEQ ID NO: 381561 - DNA, 1494 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgcgctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagtgagtgtggaggggcccgcaccccgcgttccctcctttagtgtcacccgtccaagcgtgttcgtgggcaggcccccaagacccagcagcagatgaggccgacgcggatgctgccccccaagcctactccaaaacagagactgcaataaaggcctggaaggtgccgaccagccaggccctctgatttggccggtgggggccatcggtgacgtgggaacgatggtttcagggaagcagtggctcagagctccgtgacgttttttggaacgggaggtgcgagatgcagacatttaacacatccggggctgtagccaggcagaggagcgtcagaccccccaccctgtttggaagggagaacccatcagattcgccttgggtgtagatgaaacagaaataaaagaatcaaagacga

SEQ ID NO: 381562 - DNA, 1807 bp, Homo sapiens
ccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccagggaatctcggactgtgcatgtggatcactgtgctcctgttgcaaagtagaaggatgtgtatttttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaa

SEQ ID NO: 381563 - DNA, 7364 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatggaggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatatttgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacacgctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagtcggccctcgggggaggccttgcccaccttggtgaggctcctgtggcccctccctccccctcctcccctcttttactctagacgacgaataaagccctgttgcttgagtgtacgtaccgc

SEQ ID NO: 381564 - DNA, 7177 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatggaggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatatttgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacacgctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagtcggccctcgggggaggccttgcccaccttggtgaggctcctgtggcccctccctccccctcctcccctcttttactctagacgacgaataaagccctgttgcttgagtgtacgtaccgc

SEQ ID NO: 381565 - DNA, 1022 bp, Homo sapiens
gagcatgatggacgtggacagaggacatggagaagagagaagaaattatcattaaaaggaggtgtcaccagaagtggttagaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctggtgagtcctgggcactgtgcccctcccagtgccacgtcttgtctcggtacagctcaggcttctcccacatctcctgctgatccctgactctgatccaggccatgtcagaagctgagtccatgctgatggcccttgtttccccagagatggcgactttgttagccagagaaagggccgacatggtaacgggctcctgtgggcccttccttgacatccgtggaaaagggttacatttccaggggcaactgttccttaacttccagcttctagaaggtcatccactgtggtgatgggatgtgaaggaacagcatcccagccagtgtacggggaaagcagctggactgggtggggaggtcggcagggca

SEQ ID NO: 381566 - DNA, 3223 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatggaggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggaggccacggagaaggaggctgagatagtggaagccgacaaggaaaaggagctccggaaccaccagccccggtgagtccgcggctgggcggggtcagggagggaagggttggccggggcggcgcgggccccagcggtggctgcggccatggggtccacggcg

SEQ ID NO: 381567 - DNA, 1563 bp, Homo sapiens
gagcatgatggacgtggacagaggacatggagaagagagaagaaattatcattaaaaggaggtgtcaccagaagtggttagaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtctgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccagggaatctcggactgtgcatgtggatcactgtgctcctgttgcaaagtagaaggatgtgtatttttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaa

SEQ ID NO: 381568 - DNA, 531 bp, Homo sapiens
gagcatgatggacgtggacagaggacatggagaagagagaagaaattatcattaaaaggaggtgtcaccagaagtggttagaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggtgggccaggcggggggcctccatgctttctgtcgggctagtcggggagctgtcgggctagtcggccccgactagcccgacagggcggaggcagcatgcaggcatgtgaactgggtggtgggggaagcccaactgtcaggtaagcagaaatggtaggagctatcgggctagtcgggg

SEQ ID NO: 381569 - DNA, 198 bp, Homo sapiens
gctgaacctctgagacaataggaaattttccacttagtagagttacttaggccatgatgctttcctgggttggtttgatatccagcattggaagacgtcaaaattagtttctgtgatcaggtttgagtcaccactgcagagacagcatcttgatgtttaggctttgggcttttggtttgtagcccaggctggatgtgt

SEQ ID NO: 381570 - DNA, 216 bp, Homo sapiens
gtgacccagatggagggggaggcccaccgtgctgccccaggctttttccagcacgaaggagttcttccttggggtggaaccccttggtgaattaggaagagatgtgcggtgggaagaagagaatggtgcagtgggaggaggggcagaggccaatcctgaacgccccaggggccctttgcaatgcagagcggtcctggcaggggacgcccaagtggc

SEQ ID NO: 381571 - DNA, 440 bp, Homo sapiens
ggaaagaggtttatttgggttatgattctgcaggctgtacaagaagcacagggccagcatctgtctctgctgaggacctcaggaggcttccactcatggtggaacgggaaggggagctggtatgtgtacagagaccacacgaagagacaggagggaagacagacgggagacgccaggctctatttaacaaccagcctgtggagaactcatagagtaaaaactcactcatgcttcaagaaaggacattgatctcttcaggaagaatccatcgtccgttgctcaaacccctcccattcgacctcccatccagcactgaggcttacattttaacctgagtttgggagaggaggaattttaaagcagagcctgtagattctaaagcaaaatattctgggtctcctgcttgtagaatggttgtgagtgtgacttcctttttctat

SEQ ID NO: 381572 - DNA, 879 bp, Homo sapiens
agacatatgccatgtgaagacgcagggagaatgtgacatctgcaagccaaggagagaggctgcaggagaaaccagctctgctgacactttgatctcaagctctggccaccagaactgtgagcaaataagtgtctgttgtttagggcaccctgtccatggcaccttgctccgatagccccaggaaacgaatccacagaggaggaagccgaggttgggaaaggtggagggacttgcccaagtcacacaaacgacaactcagaagagctgagaattggcacccagggcaactggagtccatcctgagcttgtcactgctgggctctgagacctcctggtgaagaaggacagtggcagagacagcccgacccagagaaacccagcaacgctactttctaagggcatttttccctctcatttggaatcctgagcctcctgctcgtcctgtaggccacacccagcaaacagagctggctgggaactgggagaagagctggagcaacagcctgcatccatttcctcttgctgcaataacaactgatcacaagatggagtctcactctgtcaaccaggctggagtgcactggcgcaatctcggctcactgcagtcacctcctctcaggttcaagtgattctcctgcctctgcctcctgagtagctgggattacaggtgcatgccaccacgctctgctaatttttgtatttttagtagagacggggtttcaccgtgttggccaggctggtctggaactcctgacctcaggtgatccggctgcctcagcctcccaaagtactgggattacaggcatgagccaccacaccttgccacaaatgtggtttttaaatgtggtttttaaaaatatcttgatagccatatttcca

SEQ ID NO: 381573 - DNA, 804 bp, Homo sapiens
agacatatgccatgtgaagacgcagggagaatgtgacatctgcaagccaaggagagaggctgcaggagaaaccagctctgctgacactttgatctcaagctctggccaccagaactgtgagcaaataagtgtctgttgtttagggcaccctgtccatggcaccttgctccgatagccccaggaaacgaatccacagaggaggaagccgaggttgggaaaggtggagggacttgcccaagtcacacaaacgacaactcagaagagctgagaattggcacccagggcaactggagtccatcctgagcttgtcactgctgggctctgagacctcctggtgaagaaggacagtggcagagacagcccgacccagagaaacccagcaacgctactttctaagggcatttttccctctcatttggaatcctgagcctcctgctcgtcctgtaggccacacccagcaaacaggtgggtttcatttcctggagaaaccacagatggaaagtcccagccatgggctccgtgtgacctggtggccttaagaagctccccccaccgcccctcagccctttaatcatttacaaagcagggccacacagagcatctattttctttctggaacatcagagctggctgggaactgggagaagagctggagcaacagcctgcatccatttcctcttgctgcaataacaactgatcacaaggtcagtggcttaaacaacacagatttactctcttacagtctgaagtaagagccaagatgtcagcggggccgtgttgcttccagaggccctagggaaatcc

SEQ ID NO: 381574 - DNA, 315 bp, Homo sapiens
tatggctgattcaacaatgcagcaaaccccagcagtttcagtagttccacaccttccgcttgttattaaggggtgacgttcaatgtgctcatgaggacgaggtcaggcctggcccaacctggaggccaggtgatggtccctagttggatgatctgaagacatcttttgatgcagtttgggttgaggaaggcaagagatgtattgatgctatcataggagtgaatcaggtgaggtaaaggcaaggaaacatgatatgaagtagaactggattcattataatatatgtgtgatttagtcacacaaatataccggcaa

SEQ ID NO: 381575 - DNA, 397 bp, Homo sapiens
taaaaatagttttgcttaaactcagaagggattattgggtctcttgctttgtgccaacaagaaaatgcttggttatgaatataaatatgaataaaatgctgcactgcagaagtttatattaacctgtctgtcccttccaaacatgtttccaaggagtaaaatgctaattatttcagccacataaatacagaaaaaatagtttatcttggaagtcaaaggtttctggagcctattttgttgggagagctgtcttacctatcagactggcctttttgcatttcggagaatgtatcttatatttcttgacagtcatctgaagtgaattcagacaattccttctgctacacaaaggtatactaccctttatatataaagagctctcagaaatcaaatagga

SEQ ID NO: 381576 - DNA, 391 bp, Homo sapiens
aaacccaggcaatcaagtgagtacaaggtaaagataagtatggtttagaggagaaattatgttcctgaactggtgtcctttgatggcagcgtcagccttgctaagtcagagtagagggagcagtgaccttaataagctttggtgagcatcatgtgcacgcgtgggtgggagtccctttcactgatgcttttaaaagtgcttttgcagaccctggaagggatcctccacacatatgaggtgtgggacaggtaggccagagaggattagccctgctttcgagactagaaatctacagtcctgaaggagcagtaattaattggtacacctgtcagggccagcccccaggtctcctggctttttccaggttttctgtctcacatgattttgcttt

SEQ ID NO: 381577 - DNA, 378 bp, Homo sapiens
gcagctgcctactgcctcggacttcaaggggctactttaggagcaattatcttgtttactaaaactgaataccttgctatctctttgatacatttttacaaagctgaattaaaatggtataaattaaatcactttaaaaccatgtctgtacatttttagagggcttcagcagggcattgaggaggtgctctgtgtatgcatagaatttgcaatatcaaaaagaaagtattcgtaagagaaatgaggaaatgtgttacagtatttttattttttttaaaagcgtagtagggcaatatttcccagaaaaatctatgaagtgatttgttttgtcctgccctttctgcagtttcaaaataggtgttttttagacccattcac

SEQ ID NO: 381578 - DNA, 999 bp, Homo sapiens
gagtctctttgggccagccgggctgctgcagacagacaggaagcacgcctgacgctcctctaccctcgggcagcacagcggggctgggactcactctagcttgcccagcaacttgctttcctgtgtgaactctggcaggctgccctctctgtgcaaagctgccactggggcctgctcagggtggcctggaacttggaggtgggcagtcagggcctaggatgggcctgtgtcaccagggcatgtgcccttgggccagttacttcctctcagagccttgggctcctcctctgaggatggggcttgttggtgtgaaatgaggtgagcatgttgagttggggagcagcaggacacgcacctgcaggcagccgccctggccacgctccctccctaccttccgagtcctgggacagacacagtagagcacagcgggccagcctgctctcttctctgtctactttttgcagaagagtcaacagatacaacaggcccagggaggtgcccctgggggccccagtccccatcactccaaggggcagtcctgcaagtgacaaggtgggcccaatccctgtggaacaggtctctgaggaccacagagtggggccccagggaaagctgggagccgagctagaggcaggcagcaagtaagggcaaagctgtgcccctgcccggaagaccttcctgcccccagaacccgaccctccgcagatagccctccctgggcagcagccccccagcttccaaggcccgtgcctcaccagacgccatgctctcacggacttgtttgctgctctgtaccctgcagatctgccccagaggagcaggtgaaaagccgcgcctgccgaggtgctgtggcggtggagttttgggcagaggagtggggggaagagtttctcacttttaagattctccaaatccaagatgaagtcatgctgtgctttggaatggtagatgctcatttatgtaaaatcataataaatgttacacaaactgttagaataa

SEQ ID NO: 381579 - DNA, 426 bp, Homo sapiens
gatacaggctgggcatggtggctcacacctgtaatcccaacactttgggaggccgaggcaggtggatcacttgaggtcaggagttcaagaccagcctggccaaaatggcgaaaccccatctctactaaaaatacaaaaaagaattagccaggcatcgtggtgcatgcctgcaatcccagctactcaggaggctgaggtaggagaatcactggaacccaggaagcagagggtgcagtgagcagagatcgtgccactgcactccaccctgggcaacagagtgagactccatctaaaaaaaaaaaagatacacattaagtttttcacacaaattcttaagggcagatattactaaatgccattagaaaaaaaggaaaccttttatcaagcattttttaaaaatgcttctacatttcttatttataggta

SEQ ID NO: 381580 - DNA, 1055 bp, Homo sapiens
cccacgcgtccggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtgaatacccagcaattactaataagctttattagagcaagttggaaggttcaacctcttaacctagcaagagagttttcttgggtggttgtatttttgcatgcccttttaaagaaatgtagattactagttgtacatagagtgttcagaagtaggatagctgattaaattgtgaatcctttctagttaaaaaaaaaatcctgactttgttatatctgtagcttcactcacgttgaacataagattatcacatgcaaaagcaaacaaaatgtaaagcttccatataactggttatttattccatttgacaattttgaaattcagaaacatgatgtgataggttattgtggaagaaaaattagaacatttatggtaggaaaagagaataaagatctttgttatgaaagaatgatttctgcgttaggaatagcaatctggacacctgccttccaaacccaatttacaattcatttactttttagaagagtaattttacaaaacattctgtaacttcataagagggcatttttgttcattggcggtaccataacatttgaataagttatggcttttaaaaccaagttcttgttcttgctaacccgcttagtgccattaatagtgccattagaaattatgtatcttgattcttgatccacaacttgaaaatccttgtaccagaattaaaaattaggaaattatacaagtatacaaatcatgtagtattagaagatattccagagggaaaattggtgatcaacagttgtccagcacccccagtactggatagttttagatctattttaatctccttaataagtcctatagctatgcaagtgagtgcattttgataactgctgtgcctaattt

SEQ ID NO: 381581 - DNA, 3581 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381582 - DNA, 4358 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatggcccccagtccctacaagcaagtgcaattaaaaataaaagcaaatgttactgagccctgctgaactcctgataaaaaaaattatgtttatggtacatataaatgtctcaatcatgcaaattgtcactcttgttaatgaaacaattttgtaaaaagatagtcctctaaaagggtttaatgttttttacctatctaactgtctaattagatttacacatcccgcaaggcaggggagcctgaagcttttccaaaccaaatcgtttgccactagaaactattttcagctcttc

SEQ ID NO: 381583 - DNA, 2956 bp, Homo sapiens
aggcgggggctgggaggaggtgccgcgaggggtggagcgcgcagcggagcctgctctcggagttttgacagtaccggagctgaaattgtcagcggcggcaagcgcaggaaagttgagaggagctcgtggccccagaacaaagcttgagaaaaaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381584 - DNA, 2542 bp, Homo sapiens
cctaacaggctttggagctggcactggtgctagctacaaaggtgacttgtctactgaagacacatgggatccactgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381585 - DNA, 2855 bp, Homo sapiens
ttttattaagggccaagcactgttgaaagtgctcccatatgtattatgtaattatcataacagtgtcattatcccttctttaaagatgaggaaactgagacacaagcagtttaagcaacattccaaaaggttacacggttaagcatatgaacccaaaacttcctaggtaggaacttgtcttggaatgtccccgctatttaaaaaattcaagatcccactgctgggcaagatgttacattccttttggaaagacacttgctcttaacagagttaagcaattaattgtagtactttacaccagaaactttctgagcgtccatttactgtctcattttctttgctagtaaaactgcagaaaatgttatgctttagttcttcactgccagagtaagtagcatagaaagcctctatcaagtcacagttggaaagtaatctaataaaagaagattagtgaatgtggggaagacaaaagcagtcatgtttgagtttaatatctctcaaatttagcattttagctaagatgcccgtttttatttcttgcaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381586 - DNA, 2358 bp, Homo sapiens
ctccggggagacagaggttccagctgaactgagctctgcaccactgcactccagcctgggcaacaagcaaaactccgtctcagatagaaagaaaagaacagaaacacctttgtaagcacacataaagaatatgttattagacaattttcctttttccattaggccctatgatgccaagtagagaaatccagccataaaaggcagatgtaagcattgctaactttttctttttaagatacactgtacttagactgaaatgcccagtgctatcaattatatatataggcaattttctactaagtctaactccccggggatacagcggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381587 - DNA, 1319 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaagtctgctaaaagtcagagtaatgcaaagaatcagccggtaccgagctgatt

SEQ ID NO: 381588 - DNA, 2136 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtgaatacccagcaattactaataagctttattagagcaagttggaaggttcaacctcttaacctagcaagagagttttcttgggtggttgtatttttgcatgcccttttaaagaaatgtagattactagttgtacatagagtgttcagaagtaggatagctgattaaattgtgaatcctttctagttaaaaaaaaaatcctgactttgttatatctgtagcttcactcacgttgaacataagattatcacatgcaaaagcaaacaaaatgtaaagcttccatataactggttatttattccatttgacaattttgaaattcagaaacatgatgtgataggttattgtggaagaaaaattagaacatttatggtaggaaaagagaataaagatctttgttatgaaagaatgatttctgcgttaggaatagcaatctggacacctgccttccaaacccaatttacaattcatttactttttagaagagtaattttacaaaacattctgtaacttcataagagggcatttttgttcattggcggtaccataacatttgaataagttatggcttttaaaaccaagttcttgttcttgctaacccgcttagtgccattaatagtgccattagaaattatgtatcttgattcttgatccacaacttgaaaatccttgtaccagaattaaaaattaggaaattatacaagtatacaaatcatgtagtattagaagatattccagagggaaaattggtgatcaacagttgtccagcacccccagtactggatagttttagatctattttaatctccttaataagtcctatagctatgcaagtgagtgcattttgataactgctgtgcctaattt

SEQ ID NO: 381589 - DNA, 2442 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaattaaaaaaaaaaagaaaaaaaaaaaaaaaaaaaaaaaaaaaaaaaaaaaaaaaaaaaaaaagaaaaaaaaaaaaacaaaaaaaagaaaaaaaaaaacaagaaaaaaaaacaacaacacaaagaaaagcagaacaaaacaaaagagaaaaagaacaggaagaaagagaaagaagagacaagcaagcaaagaaagaagacataaacaaacagcacacagaagagacagaggcgacaacaagaaacaacacaacaagagagaaggaaagactagagagaggacatagacgagcagcagcagagagaacacgaccacgaacgcgaagaagaagaaagagaggaaacgaggacgacaggagaagacagaaaacaagcagacgaaagaa

SEQ ID NO: 381590 - DNA, 3154 bp, Homo sapiens
aggcgggggctgggaggaggtgccgcgaggggtggagcgcgcagcggagcctgctctcggagttttgacagtaccggagctgaaattgtcagcggcggcaagcgcaggaaagttgagaggagctcgtggccccagaacaaagcttgagaaaagtaaacaggcggctgctgccggcgagcctcccttcttccctctccccctcagcctccttcccgcccttgccctgctgtttccttccagcagctccgcggggaggaggggaatgggcttgctctctctccggcgattactaacttttgcatcgcccctgttttgtctttctctccctgtccccttcccgccctctgcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggtt

SEQ ID NO: 381591 - DNA, 686 bp, Homo sapiens
caatctcggctcactgcaacctctgcctcccgggttcaagcaattctgcctctgcctcccgagtagctaggactataggtgcatgccaccacacccagctaatttttgtatttttagtagagatggggtttcaccatgttggccaggatggtcttgatctcttgatacctcatgatccccccatcttggcctcccaaagtgctgggagtacaggtgtgagccatcgcgcccagcctaaagtgatttttaaaatctttttaaaatttgtattcctttttgactaacttctccctgattctgaaaatttcactgaagtttcaaagttattagtgtgcatatggtgaagataataatataagctcctcaccctgttttagtaagaagtacttagagattttgtgtgtgtttttttggggggtgcttaggatggggtgccgggagatcaacttagagaattttgatttttggaacttcaaatggaagatgtgttaaatttgttgcagctttgcttttgcagacatttatgtgatgtaaagttctttttaaaaattggaccgggtgtggtggctcatgcctctaatcccagcactttggcaagaggatttacttgagcccaggagtttgagaccagcctggggaaacatagggagacttggtctctacaaatatatatatgtgtgtgagag

SEQ ID NO: 381592 - DNA, 610 bp, Homo sapiens
cctgacctcgacctgagacgtggaggagggacagggaaaaagccttcttctcgcagctgcaggttgccccaccgagggcatttttccgcaccgagggggcggggggcagaatgcacgccagaaaacctaagtgcgctgggtttaaaatagcaacaacaacaaaaattacaaataaccaaaaaacagcataagaattaaaaacagttatattccaatgtttttaatacttggttcacattttggatgctctccccagggatccgacggcgctgcggaggcggcagcgatgtttgggatcctaaagaaagcatcagaccagactcaggtctggacgtccctcaagtggcccggaggtaccgatattagtgtcaccgccgtcagtgccctgcccagaaataaaacctttgttctgagagaaattgaaaagctggaaaatatggagtaggcgatgtgaagagaaactacagggaatgtagaggtcgggttttaaatgcgtatttcctcaaggatgttgtggaagcagagacaaggtggctggcctggagcaggctggaggacctccaaggatctccacagggaggcagttacatttaacaccctacctagcaaa

SEQ ID NO: 381593 - DNA, 393 bp, Homo sapiens
aaataaatcattactaatcaggttaagttggttaattaaagtgattagtaattgttataaatacatacatatacatatgcacacatgcacacacacacatattatgttctgggacccttattgagtggcctctttattctaggttgagtccctagaaattaagacaggatcaaagaattcatgaatatgcataaatgctaaactgtaaatgactttatgcttaggattaaagttttgtagctactagaataggaagcaacctgaaacattcaccttgctgatgacttgaacgctaagttgccactttgcagccttactgtgcacatccacaaatgcgtttatgaggtatagttgacaaaaggcaagtatgtaaattgttttcctctgactggg

SEQ ID NO: 381594 - DNA, 390 bp, Homo sapiens
agcagtcttacaacctgagtattttctatcttcgcagattcacgtgtctggatttgttgacttagtgggttggcacagggtacatgcagaccccaggtcaaatgagtactgagatttttctcttctatgagatgtatttcaatcccctgaagtttccacgggaattctttatttcatggtggatgaggtcgtatgtcctgtcccataactgtcctgccaccatcacctgattttcaaccataacctgtttttggtcatgctctgagcccccattttttctgtaacctccaggtggtgtttaagctgctgcaccccattgaggggttagtggtaatcgctctgtggttccctctgtgtgcacacgaataaatttgtatgccttttctccaa

SEQ ID NO: 381595 - DNA, 530 bp, Homo sapiens
aaattgattgtggtgctagttgcacaactctgtgaatacactaaaaaccactgaattatatactttaaatcgataattgtttttgaaaattatatacatccaggtagcaaccagccaaaaccagatcaaaaacattttcattacccccaaaagttctagcctgtctatttccagtcaatcctctggcctccctgaaacatttctctctcactctccaccaccaccaggctgagatgtttgacttctctcgtgatagattagttttgctgatcctagaacttcatataaatggaatcatacagcacatgtatgtattcttttgtgtttggcttctttcactcagcagattataaaattaatacaagtttttctttttatcagtagttcttttttattgccaagtagtattctattgttgaaatatatcagtttgcttatccattgtcctgtggatggatatttgaattgtttcctgtttagggctgcatgaataaaattgctatgaatgtttgtatacaagtctatttgga

SEQ ID NO: 381596 - DNA, 271 bp, Homo sapiens
agcagaagcgtcctcagtcacggcggcacaggctctgggcctagcaccgaacgtctggtccctggcctgtgcacaattcgtacatcagtgatcacactgttatttcccaaacgacccttcagctggatacgacatttcctgattgcagctgtgcttattgcacttaataatgttctggtcatccttgtgccaactataaaatacatcttcggattcatagctgaagggtcgtttgggaaataacagtgtgatcactgatgtacgaattggg

SEQ ID NO: 381597 - DNA, 3736 bp, Homo sapiens
gcagcgcctggagcatgagccgggtggtggcgtgcacggaggatcgcgggaggctgccgcctcgggacaccccactcacacagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgcacgagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacattattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381598 - DNA, 3826 bp, Homo sapiens
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgcacgagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcgggcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381599 - DNA, 3674 bp, Homo sapiens
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgcacgagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381600 - DNA, 399 bp, Homo sapiens
tttttaatgactgagtctaggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccgggtaagtgagcggtccgggcttctaatgagtacagttatgtgttttctaagtttttattcaataaactgagatggcctgagatcaccatctatgttggaatgct

SEQ ID NO: 381601 - DNA, 3982 bp, Homo sapiens
gcagcgcctggagcatgagccgggtggtggcgtgcacggaggatcgcgggaggctgccgcctcgggacaccccactcacacagagctgacgcaagttggacagaaggaggtgttggggtgaggtggtggtgttgattggcttgtctcgttcactcccactggtctttaaatcaatgtctagatctctaaagtttcatataaatcaaagctgttacacgggtctgccattccaaacaagtcaggaaagcctgcacaggactggataaataattaagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgcacgagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381602 - DNA, 1738 bp, Homo sapiens
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381603 - DNA, 3790 bp, Homo sapiens
gcagcgcctggagcatgagccgggtggtggcgtgcacggaggatcgcgggaggctgccgcctcgggacaccccactcacacagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgcacgagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381604 - DNA, 1896 bp, Homo sapiens
gcacccccggacaccgaccaacatcacgagttacgctcgatagaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggaattagttcagtttagctcacacaggtgtttgctgacattcattggccatttaatacagtgttgagtggttctccgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgacaaaaaaat

SEQ ID NO: 381605 - DNA, 736 bp, Homo sapiens
acaaatacatttgaagacaggaataggtggttgggtgggtttagacttagcaggtaaatgtccttttctcaactggctctgtccatttgttaatccgtaaaggaaaattcctggtagttcccttttttctctctggttgaaatagggttttatggctacccttagctgcaaggacagctgggaaagacttgattaacatagatggattatgatctgttctctggggttagtagtaccgtgtttttctgttggtaaaatgtggggctgggattggaagactcttgggtgtttctgccttggatatcttatataagacttcaatcagcacctatgtgctgatgatgcccttgtctgcctgagtcgcctgaacagatcagccctcatgtcagtttctcatggtttcattcagggaccaaccttagttccctgccctgttcctcccacatcaatccagtctgtctgtagggcccgtggattcttcctccctgctgaatgaccttttgtgttactgaccgtctagcctacttcacctccctctccctttctctctcttgtttctcttatcagcaccttttcagtgctaataactcttttttttctccagtgtttaacattttattgttaatactagataatattagattgtgaatttttcttttggcatacaggtttatgatttaacacgtgctattcatgtaactaccatcataattatatatgtaacaattctatcatt

SEQ ID NO: 381606 - DNA, 340 bp, Homo sapiens
gaccatttttaacattcttccctggcttctactagattactccattttgtgaggttcttggggctctttctgctgacctgccacattgtttctctgcaaggtctttagcagggtttatctttgtgcttctggcgtgccctgggattgggatggttttgggagagcttttgctatacaccccagggtatcgccagcccggcaccacttttcctatcaatttcttgactatgtggatttttgaaaaatggaacaccagttcaggcccttgcttataggtacttggggctggtgtgacgacagagcagcttctttgttgatcacctgtgctgacgggcagttt

SEQ ID NO: 381607 - DNA, 173 bp, Homo sapiens
agagccccaggtctttttgcatattaggaggccatgtaacttgaatcttaattaccctaagccaatcatggatagtccatcctccttgccagtgtttggtggaggaatgtatgtgaagcagttctaacctctaagatattagaagaagggttctaggggggtggtcctctacc

SEQ ID NO: 381608 - DNA, 3218 bp, Homo sapiens
ggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtctgcttagtggcctatcttggcttgtttatgctttgtgtctcatatcaggttgacgaacggacatgtattcaattttctatgaaactgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaatggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctattaaaaaaaaaaaaaaaaaaaaaaagccagtaactgaatccattttgatttttggttgagtttcctacacaaagaagaaaataactgagaatctggaatgttgtagtccatcctttaaagagtaagaaagtagcagttaatgctagtaaccgtgaattaggcaccactgaaagcacatcccgaatttctttaacaacaacattttatagtgaacactacaagtttttatatttaaaaattaagactctgtatatccttaaggtgctctatgctttaccagtaattcacagggtatttcaaatggtagaatcattttagcttctgtgcttcctttttctaaataatgcaacttgtaagagttgacattgtaataagctttataatagtataaccgtcaggagatatatatatatatatacacatacacacacacacacacatatatactatacatatataaaatggggatattactattgtatgattaaatcattcttaagtccccaaggaaaaaaaatcataaacaaatagaaagaactaaacagaa

SEQ ID NO: 381609 - DNA, 369 bp, Homo sapiens
attacacatgattagcaatgtaatcagttacctagagaggtaaagtgtaaggaaagtaattatttgaagaatgtaagccattgttaaattaggaatttctttcattattcagatctgattagcatgaaatataaatcacaagtgtgatactgatttaacagacaaatatatttacttgtataaatattctcagtatttcttagctttcagaaatgttaattcttaatgcaaattacactgacatcacatttttctgtatttgttaacgtaagtatatatcttaaaaatttaaaaagtaatatggcaacaacgtgacttaaaacactatcctccaaaaaaagattaagaggtgtttattatttgaaaatg

SEQ ID NO: 381610 - DNA, 239 bp, Homo sapiens
gaagattaaaaaatgttctcaagggatttacagtctagtagagaatgaaggtagtcttgtaaaaatctttgatttgaggtatatttctttaataatagagttaactgctcccaagttctgagaaaagatttcttagaaacaagatttatcaaacagcagaaaaagagagtgggatgatgcacactgattctattctcccaactgcaaacattcctctcaaagaaataacaactaaatgc

SEQ ID NO: 381611 - DNA, 453 bp, Homo sapiens
attggccaggctggtctcgaactcctgacgttatgatcctcctgcctcagcacaaataactgccttttttatttctcaagacttagaagtccttgaagaacaaaaggatgctggaaatataaaagatggttctcccttaaaactaaaaaggattcataagacaaaagataaagagagacataaaattggagaagaggttatattgagagtactatcaaagagaagccatgccacaaatagttttaagcaagaaaataaagtctgccaacaaccacgagcatgagcttggaagcagatcctccatcctggtcaagtcttcagagactacacatccgggccaattgtgtgactgcagcctcacaagaaaccctgatccagagccactcagctaagctgctcccaaattcctgactctcagaaactgagataataaatgcttgttgtcttcaacca

SEQ ID NO: 381612 - DNA, 348 bp, Homo sapiens
taatagagacggggtttcaccatgttagccaggatggtctcgatctcctgacctcatgatccacctgcctcggccccccaaagtgctgggattacaggcgtgagccactgcgccagaccactcatagacttttaataaagaatgttcggataaattagatacatccatatgttatgcagctatttttgaattagatcgatacttattgacaatacattcatgtcaagtaaaagaaatcagaatgcaaaataatgtatgtaaaatgaccccatttaaaaataacaacaacaacaacaacaaagaaatgcatacctaagtatacatgtctttgtgtgagcatagagaaag

SEQ ID NO: 381613 - DNA, 418 bp, Homo sapiens
ctggagtcattctacagtggtatagaacactagaacttattactgtctaactgtaattttgtatcttttaacaaatctttccatgttccttgcttcccacctcactttccttgcttcccacctcactttccaacctctagtatcctctgttttactttttacttctatgagaagtaaaacacttttttagggagggcttttgatacccatcaaagatggagttcatgaaggaagaattggcattgagaagaaagagagtttctgcccattggttgttttaaagtacttattgtgaaatattccaatatatttaaagttagttttttattagtggtgacttaaattttaactctctagtaaggaatagaaagcttatgactatagagaatcaatatggggaacattagacaaaaatact

SEQ ID NO: 381614 - DNA, 372 bp, Homo sapiens
ttcgccacgtcagcgagcggccagagccacagatgatgactgagtctccgaggcctctcggtctttttctattttaacaggggcgcgtgcagagcgtgagacgaggtcttgctttgccatccaggctggagtgcagtggtgcaatcacagctcactgcagccacaaactcctgggctcaagtgaccctcccacctcggcctcccaggtagctgggactaatagggtcatgccaccatgccctgcttgatcactcttttaaacattgttcttctcttaagaaaacaaacaaaagatttaccttaccataatctacacttttccatcctacttaacattttctaacataaattacttatgtttattgccttact

SEQ ID NO: 381615 - DNA, 498 bp, Homo sapiens
acgtgaaatgctggggctttgagcactgggctgatgagcagggctttgtccaattccttctgatttctctgctgagatccagagcagggtctgccaaggtgtggagctcctattgcaagtccaagcgctgcctggccaggccagaatcgtggagcccagcgctctctccccaggctccggccacagcctctgaattctcagcatggtgcccagcagccgtcccaggagcagccactggagcaggcggccttcagtcctcacccaggctttccgcagctgttcacgcgaggtcctttcgggcaccttgtgcctgagctagtggagctcctgagaggctgctttcagggacagagaatggccatgtcctctgtttgtgaaatgctctgcagcttacaggatatttttgctattctgtcttatttaatcaccttgaaaccctgtaaaatggtctctcttatgggagaaatgtggaagaataaactaaatggctcagaattg

SEQ ID NO: 381616 - DNA, 397 bp, Homo sapiens
atttgtgactgacaggttctttaagagacacgtagaagcaatgtaacctccagtgggaagaggtgggcctttggatgccatttaaatatgtatgtttaaaagtatgtaatattgagctgggcatggtggctcacacctgtaatcctggcactgtgggaggccgaggcaggcggaccacctgaggtcaggagtttgagactagcctggccaacgtggggaaaccccatctctactaaaaatacagaagttagctgggcatggtggtgggcacctgtaatcccaactgctggggaggctgaggcgggagaatcgcttgaaccgggaggtggaggttgcagtgagctgagatcgcgccattgcactccagcctgggtgacaagagcgaaactccatctca

SEQ ID NO: 381617 - DNA, 621 bp, Homo sapiens
tttgtacattgtgtaaaagtataggtccaacttcattcttttgcttgtggatatctagtttccccaacaccatttgttgaagagattgtccttttccccattgagtgatcctggaacccttgctgaaaattaattacccatagatgtgagtgttagttctggcctctcgattctattccattggtctatattgtctatctctgtgccaagtccatgctatttcaattattatagctatgtagtacattttaatatcagaaaatgtgagtcctacaactttgttcctcttcagattattttggctattttgggttccttgaaattttatatgaattttagaataggtttttccgtttctgccaaaagcgctgttgggatcttattagcgtgattacattgactctacatatcattttgagtagcgttgtcgttttaacaatattaagtcttccaacttatgaacacaggatctctttccatttatttaagtctgctttaatttctttccagaatgctttgtagttttcagtgtacaagtcttctgccttcctggttaaattgatttctaaatattttattcttttgggtactactgtaaataaaaaattcttaatttccttt

SEQ ID NO: 381618 - DNA, 323 bp, Homo sapiens
tcaggcaggcctacgccctgcttgttctgggatgcgtgatctctgcgtggctggctcagttgtgccagggcttgggtgagggttacttcttccctcctgctgcctactgtgttttagcagagtctgatagaaacaaactcgattactcgcttagccaaactgagctagaaggcctgtattgtggaagaatccccagcatcatccttcaaaagtgaagctgggccaggcgtggtggcctgctgcaaatcccagcgctttgggagggtcacttgagtgcaggagttcaagaccagaccgggcagtatagcgagacctcatctcta

SEQ ID NO: 381619 - DNA, 290 bp, Homo sapiens
ggcaccccatgatgtgcaccccgccctggaactctcacaggctctccggaacccactccccaagaccattccctggacaccatactatcaagcaagacttggacatcagtgggtagtgatactcttaagggcttcccagtccactgcagtcatggggcagatgccccaggcaaggagcttcacctggacactggctctctcactcgccccagcacaggcacccagggcccatgtgtcccaggctatgcatccccatctccctccattccattaaaagtccatctctcagc

SEQ ID NO: 381620 - DNA, 524 bp, Homo sapiens
ggttgcagtgagccgagatcgcaccactgcactccagcctgagcgacagagtgactccatctcaaaaaaaaaaaaaaaggagttacccaaacaccaactgtttagttaggccaatgggcatataccagcaccaaggtaaatgtatttttatctggtgcatagtacaggtgggcacctttccaaatgggctacagcccatcagccttctacagtaacctttaattaatggaaatccctctagttcctatggcaacaagaccctcagttatcatttacatttcagactctctcagttcaaatgttattctttaggtgtagttggtatagaagttattattcctaggtaattcaatttagaaacggagaggttttgatgaaatatgtacttgtgccacattattccttcctgttttctcccatctataaaacaatcctatttaaggaatacttttttccagagtaaatgactccccttgaagaatacttaagtaggaattatactaaaaagtacctttgagaaagta

SEQ ID NO: 381621 - DNA, 510 bp, Homo sapiens
ccaggattcagtattattagaattactttttaatggtattgaaggcagagaagcttaatttcaatatatatctctgaatttttactagggaccatcttaggtctcactgaaatgtggattcagagttcagcctcaatagttgctaaatggcctgcttccttacaccagcaaccagccccagtcattctgtatttgccaggccattcatatgtatgcactgatttcatccccacaggacaaggttttgacctgtcacacatgacctcacctctgtggcttgccagggttggtgtgaatagtttaaccaaggctatcgaaggcctaactgtagcgatagcagttaacctatgtaacttttttgagtcatttgaattatgtagagattggacctgtaatcccagcactttgggaggccaaggtgggaggattgcttaagccctggaggtcaaggctgcaatgtgccactgcactctagcctagacaacagagtgagaccctgtctcaaaaaaa

SEQ ID NO: 381622 - DNA, 214 bp, Homo sapiens
tatgacgtcagcctcaatttctcttccggggcgggagcccggccgacctctctgcatcccctgcaatcctctctgctgattaatacctccttgtccttcagctcccagctcacgtgtcagctcctctcactccacagactgggtcagacactctgaaatgtgccctgcatctctccttcagagcccttagaccaatttacaattcaatcattat

SEQ ID NO: 381623 - DNA, 1290 bp, Homo sapiens
acgcgagggggaccggcggtccgggcgaggcctcggccgcgcatcgcaccccggctccccgccgccggagtgagggggaggcgcgctctccgtaagagccggaggcggggcgccatcgccctcccactccccggcgggcgggccgggggagcccggggctgcgaacacccccagacgggcggctgcgggaggggaggctggaccaaggggcctggtccaccggaccagcggtggcggcatcggcatctcgcctccttcaggcctgcacgcgccacaggccgcagcctggaccaaccccgcgtccccgggccgtgagcgctgcggtcccggccccccagagcgggacgccgggcggccgcagccccccggacccggctctccgcccgctccgcccgcagtcccggcgcggagagcggccgcccgagccgctgccgcggcagcgcgggtgtcggcgacggagcccggggcggggaagagcggaggaaggggcggcgagggggcgggccggcggcggccagggaggtcggagtgcgcggggctcggcaccccctcggcccgcgctgcgccagcaccacctgcggagctgcggtgcccacgccgtgccgcgacccgccgcccctgctccctccacacgcgggcaaacaaaacaagttgccggtcgctgccgcggagggggccgggcgggtcactcaccctcatcctgctcagcgggcttgggtcgtccggccgcggggtcaggaagaccagaggaccactagccccaggaagcttcccaccaccagcaaactgcgtggtgaatttgtaaccgaaaggcccgggtgagatgtgcaaatatcactggattggaggagctcacttggaaagccagtattcctcctgagctaatgaaaagaaaggctgtcgtcttatgccaaaagcaataccaaccttgttcacgggctgagatctagagtgtgtaattcacgaagtatgaatctgctgggtaatgtgatatgaaaagcgaatgcaccatttcttggtgatgattcaggtcagcgttgggacccaggaatctcctgttaatcagtaccctggtgattttgatccaggtcatcaagaccatggcttccatcgtaggcagtcacactctttctctcttggatcatttgctgtggggaagcaaactgtcatatgagaggacactcaaacagcctctggagtctcatttgctaaggaactgaggactccagcctgagaactcaggcaagtaactgaggcctgccaacaaccatggagaaagcctggaagtgg

SEQ ID NO: 381624 - DNA, 397 bp, Homo sapiens
atcactgcttgacttagcatttatatcagccccttaggttaaaaccagttgttttaagtagaagatgagagattttgcctaagaccattttttttgtgtgacagagatctagagtgtgtaattcacgaagtatgaatctgctgggtaatgtgatatgaaaagcgaatgcaccatttcttggtgatgattcaggtcagcgttgggacccaggaatctcctgttaatcagtaccctggtgattttgatccaggtaatctgggcaccacctttggagaaacactgaaaggaagcaaggttgcggggggtggttgggaaaagtcttatatggatatctttggaagacagaaataggctcatttatggactcaacttgaactgttcagaagtgaggtggact

SEQ ID NO: 381625 - DNA, 446 bp, Homo sapiens
ctaagtgaaattccaggaatattacaaagattttaccagcaatgggcctcatgagggacctaactgatgaggaattcaatccctccctactacctgtgtcttcaaagattctgaatgtcaaaaaccccaactaataaagagatccttaaatgattcattccctggacaaactccgtgaccacctatatagatctttaataggaatctcccctggacaaattttttttttttttgactgagtcttatactctgcactccagcctggtgacaaagctagactccaactcaaaaaaaataaaataaaataaaataaaataaaataaaataaaatagagtatcttagccaccacacccagcctaagaatggtgtctttcaaagagcaaaagtttttcattctgataaagtcaaaatgaaatcttaacctaaataaacacaatcttaacac

SEQ ID NO: 381626 - DNA, 1169 bp, Homo sapiens
ccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgtt

SEQ ID NO: 381627 - DNA, 235 bp, Homo sapiens
cggcacgagggagcctgctgaaactggtatagaattggggtggggacacacaggaggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgtt

SEQ ID NO: 381628 - DNA, 3049 bp, Homo sapiens
ccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaag

SEQ ID NO: 381629 - DNA, 3107 bp, Homo sapiens
ccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaag

SEQ ID NO: 381630 - DNA, 344 bp, Homo sapiens
agagccctgcccttgtgctgctgtagtctcctggcaagtcctctcggagttccacctgttttcacatcttcactgagttcttcattccgggaggcaggcagggggacttcccctttgagatttttgggagatttctgagttcttggctcttgggccttatcttctcactttccctgatagcacgggggtctcagtgtgctctgaggtgttttgaggttttgtagggtactttgtcatctggttgtgtgaaagctgttgcccatggagtttttttccttttggcttccttttctaagactatgtaaaatactcaatttgcaggttattgaagcaaacctagatgg

SEQ ID NO: 381631 - DNA, 97 bp, Homo sapiens
gtgagtgtgcttctctgttttgtttttcatattctttcatattctaaatactgcagtcaactctagtctaacagattgcatatagtctcataaatcc

SEQ ID NO: 381632 - DNA, 2195 bp, Homo sapiens
ccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggagttggagaccagcccgggcaacaaagtgagaccccgtctctacttt

SEQ ID NO: 381633 - DNA, 2382 bp, Homo sapiens
ccctggtaagagtcgcgtagcccgagccgggcggaaccactgttcgcgctgccgtgtttccgggcggggacactcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaag

SEQ ID NO: 381634 - DNA, 2334 bp, Homo sapiens
tgatgtgtgcctgtattactccgttttcacgctgctaaaaagatattacctgagaccagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaag

SEQ ID NO: 381635 - DNA, 1173 bp, Homo sapiens
gttaagaaccgaactccagcaaaactgaatcaaacacgctgacactgccattccgctggccccaggcctcacgctcccgagaggaagaagagaataaacgtaattcccttgccctctttcgaggaatggtgacgtcccttggcccaccgcaggccccgggatcccccctcccacgttcaacgcccccaggaccttcgagaagcggccgcgtgtgtggaggggggacgtctgctcctccagaatcactcaccgaaggtcagcaggacgcagcagaggcccagcacccacagggccctcatggcgtgcggccgtatctgtaggtcaggaatccagaagcacctaactgggtagtcaagatgttggctgaggctgaaatcatctggaggctcaagaggagctggaggatctgcttccacgatggctccttcacatggctgttggctggggcctcagttcatcatcacatggacctctccatagggctgcttaagtgtgctcacagcatggcagctggcctcccctggagtgagtgatccaagacagagaacaaagcaggaggcacaatgactcataaccaacctcagaaatcacacaccatcatttcggaaacaaccctactcaatgagattatatgaggctgtaaataccagcagccagagagcactggggcctgtttggaggctacttattataccttagttgcaaggcaagctgggaaaggatttacatggcattttcagcttctctcatgggaggctcagaatcataaggtgggggttttcctcatgtaacaatgagattcagatgctgcaaagtgaaaaagaatgatgtgtcctctacatatttgaatatacaaacagatcagtgcaaccagtcgggcatggtggctcaacacctgtaatcccagcattttgggaggctgaggtgggtggatcacttgaggttgggagttcaagaccagtctggtcagcgtggtgaaaccccatctctactaaaaatacaagaattagccaggcgtggtggtgtgcacctgtaattccagctactggggaggctgaggcgggagaatctcttgaatctgggaggtggaggttgcggtgagtggagattgtgccactgcactccagcctgggcaacagagcaagactccacttcaaaaaaacgacaaaagaa

SEQ ID NO: 381636 - DNA, 889 bp, Homo sapiens
ggtttgcagcttttctccaatcaaatggctccgcgggcccctcacacgtgggaccgcccctttgcctgggcggccttggcctctaagggaaaacgtccaatgaatgtaagcagagaacacatccatccttttagagaggtcgcggcggaactacttccggatcctagagagcgtttattccgtgaccggggaaacggtagccatggcaacgtgttcttcaccctttcccatctatgcctggggtttcgttggaagtgattccagcacgactttcgcggccagctttctcgtgtggcggcgcttctcggaaagaagaaacacacgagagagtcctaacttaaactggattgtttttcaactctgatctgtcccctggttggcatctctcaccttccaataccaataagaaacaattttcaagaaagatttccacctgttcatagcaaacataattgggaggaagattagaagcagtgggggtcggtggctgtgctaggatgaaaattgtgatattttatgcatagtgttgtccccaagcaaagagaaatgagccagaagacaaatgagaatgtagaaaggtatacccaattccttcaaaagccccagaaacccattcagccttacatctgctcgactctgaatgattttcaagaagagagagactttttggcaaacaacatcttccctcagcttaatgaactctgcaattcctggggcacatatttcaaagccgtggacctgagttggtcagcattaaaggccccgaaatccttacccacccacctgtttagacagtattcttgtcttcgctcccaacgtctgaagctctgccttgactatgtgaacagctgctttccctttttcatctgcatgctgggtcagacgtatg

SEQ ID NO: 381637 - DNA, 795 bp, Homo sapiens
tgcggatcttggctctgtggttggcgctcacgtgttgtggtggtgccttatttacatctgcccaatttacctacatttgttattagtaagcaaagagtagcttacaaagaatgctttatgtatgcttctgtgctttcatctttttttaaaagagcatactagagtgtgaattacattcagagatttcagttgcatttttgtatattttaactcctttattttttgttttgagagaaaactgagtttcttcacttttttttctgcatttcacagctcaacttcttgaccttttcctccaattctgaataagtaagcaaccagttctgaaactgcaaatgccaccttaactagtgagtggtggggagttggtgctgcacctggagagaactgagacagagacatatccttcaaaatagagccactgcttgtgggtagacgtttctgcagatgatggtgggaattcatgaggcagacagagcacaagatggtaggctggcataagatggcgggccgttgtctgatcaactctgtcccttgaagattggctctctgggctgggagcggtggctcatgcctgtaatcccagcactttgggaggctgaggtgggcggatcacctgaggtcaggggttcaataccagcctggccaacatggcgaaaccccgtctctactaaaaacacaaaaattagctgggcgtggtgccgcatgccggtaatcccagctactctggaggctgaggctggagaatcgcttgaacccaggaggcggcggttgcagtgagcccagatcacgcca

SEQ ID NO: 381638 - DNA, 1406 bp, Homo sapiens
ggtttgcagcttttctccaatcaaatggctccgcgggcccctcacacgtgggaccgcccctttgcctgggcggccttggcctctaagggaaaacgtccaatgaatgtaagcagagaacacatccatccttttagagaggtcgcggcggaactacttccggatcctagagagcgtttattccgtgaccggggaaacggtagccatggcaacgtgttcttcaccctttcccatctatgcctggggtttcgttggaagtgattccagcacgactttcgcggccagctttctcgtgtggcggcgcttctcggaaagaagaaacacacgagagagctcaacttcttgaccttttcctccaattctgaataagtaagcaaccagttctgaaactgcaaatgccaccttaactagtgagtggtggggagttggtgctgcacctggagagaactgagacagagacatatccttcaaaatagagccactgcttgtgggtagacgtttctgcagatgatggtgggaattcatgaggcagacagagcacaagatgtatctgtaggtcaggaatccagaagcacctaactgggtagtcaagatgttggctgaggctgaaatcatctggaggctcaagaggagctggaggatctgcttccacgatggctccttcacatggctgttggctggggcctcagttcatcatcacatggacctctccatagggctgcttaagtgtgctcacagcatggcagctggcctcccctggagtgagtgatccaagacagagaacaaagcaggaggcacaatgactcataaccaacctcagaaatcacacaccatcatttcggaaacaaccctactcaatgagattatatgaggctgtaaataccagcagccagagagcactggggcctgtttggaggctacttattataccttagttgcaaggcaagctgggaaaggatttacatggcattttcagcttctctcatgggaggctcagaatcataaggtgggggttttcctcatgtaacaatgagattcagatgctgcaaagtgaaaaagaatgatgtgtcctctacatatttgaatatacaaacagatcagtgcaaccagtcgggcatggtggctcaacacctgtaatcccagcattttgggaggctgaggtgggtggatcacttgaggttgggagttcaagaccagtctggtcagcgtggtgaaaccccatctctactaaaaatacaagaattagccaggcgtggtggtgtgcacctgtaattccagctactggggaggctgaggcgggagaatctcttgaatctgggaggtggaggttgcggtgagtggagattgtgccactgcactccagcctgggcaacagagcaagactccacttcaaaaaaacgacaaaagaa

SEQ ID NO: 381639 - DNA, 428 bp, Homo sapiens
acttctttccctttcttagaagaaaggggaagatgacacagtgtcttccacctaaagactttctcctccccacagccatggttctgcgatttacattaagggctgtagcaggttggagtaaatggagcaggtttgcaattagttttcaaagtacttatctcattaaagtaaatgaattattgatttagggacactcatgcttttagtgagtggcgtggtgccatcctcactctgggcttcagctcccggagccggtggccggcacaagcaaacttgctatgtgtagggaatttttttttaattttaatatttccttctcgttatttagctttgtaattaaagtggattcacatgagaaaggaagggtcggtttatgggaatagaagccccagagacaagcgtgcctccctgcaggaaggagcagagct

SEQ ID NO: 381640 - DNA, 300 bp, Homo sapiens
aaaactttgtacttttccaagaggcttcacattcattgtagtgtttaagcttctgtgaaaaccctgtgaggcaggtaaggtgagtcccaggaggttttcccagatggcgcagctaattagtgttgctggtagcattaggagtagactgcagactcctggggccccagccctttatcagggaatcatgcctttatgaattgcggaaaggcttagtgtaagccccaaggagaacctttcttccctctgggtgggtctcaggccctggggtaatgaagacttgtttgtcattgcatgtttcca

SEQ ID NO: 381641 - DNA, 365 bp, Homo sapiens
caccaggaatgcctgctgctgggaggccacttttttggaacctctggaatagacggctggaaatgagccggggggctgtggtctcagggatttccacttccctgcacctctgggaccaccctgacacccactccccaacaaaagcccaggataaaggggaaccttccaggactgtcccggaaagagctgtccgtctcacttctgggaaaccatctgaaagacagcggacggagggatgggcacgagcgctccaagggccatctggggacagttaggcttgggcagagggcctcagctgggacactgccctctctccaggccagctggcagagggcacttggaaccaaagggccaaaatcccaaat

SEQ ID NO: 381642 - DNA, 379 bp, Homo sapiens
ttttttgagacagagtcttgctctgttgcccaggctggagtgcaatggcatgatcctggctcactgcaccctccccctcctgggtccaagtgattctcctgcctcagcctcccaagtacctgggattacaggcacacaccaccacacccagggaatttttttgtaattttagtagagacggggttttgccatgttgcctaggctggtctcgaactcctgagctcaggcaatccacccgccttggcctcccaaagtgctaggattacaggcatgagccaccgcgcccggcctaggcatatattttgaactgttttagtagtggtggtgatagatttgctctaatatatcaaaattttctaattctgtctagttaatatct

SEQ ID NO: 381643 - DNA, 448 bp, Homo sapiens
ggtcttatctttataatcactttatgttcaactttgtagactgacataaatgtgagaatccttcatcagaacagaatatagatttagtgaggagataaattaggtaaaaataggcagtttaatgccagccagttacattttcctgacttctgcttattaaaggacaaacacattaatttcattttacatttttaaaaagggttataataaactaacaattctgaggctgctcctataagtattctatggtacagagtaggtatccttaaaatatttttcttgggacatcatgtagtggataaaagttacatccacgacaaactcccaaggatgttcaaggagtacttgttataaatctatttttttctcattcaagaaacagagcagaacggaagtaagagtcacattattgtaaaagcagtctcgaatttagtctaattaattaaaa

SEQ ID NO: 381644 - DNA, 398 bp, Homo sapiens
gcctgattcacaaaagcaggaaagaaaagttgcaatctgtgccttttcccctcaaaggtcatggcctagattaaccaaatatggcaaggagaatggagggcaactcatccctgtaaggaggtttgccactaaagcaaaaccacaaatgaattcaaactcttctctccagtgatgactaagggtgatcaaaacacaaaaagtgactaaggtaaagcactgatatgctattgaatttcacttacctaaactagtacttcttagagaaaaaaaaaaaaagaatattggcactttttttttcctgagcaccatgtgacaagggtctttgaattcatgaaggcactattataagtgaaggatatacacattacttatacatacatatgcacttagcctaaata

SEQ ID NO: 381645 - DNA, 468 bp, Homo sapiens
ccccaactaaatccttaaaggaccctaggttgttagggccagacgggactccggagatgactcagccttacccctcattccataagtgagaacattgaggcccacagaaaggattcaactcattcaaggtcgtgctgttagtgagagtctgagttgagaccagaacccagttcctatcccttcaggctttccatgcccgaaacaagggctcctcccaccgttgagcctcagtttatatgaagtgaggataataacagtagtttttccattagattgtgaaggtccagtggtgtaattaatgtgaaaactttgtaaactctgcagagacgtggtggtggtagttatccaactcttccaaaactgagtgatgttcagcactcagttttacttactttgcatctgtcccggagtagaatctcagtgcttgacaaatagcaggcccttggtaaatgtttgttgaataaacga

SEQ ID NO: 381646 - DNA, 462 bp, Homo sapiens
atgacccatcctcactttaagttttagcatatggtgtgaggaagggattcattttcattcttttgcatgtagatgtctggtagttccagtaccatttgttgaaaagacagttctttgtacattgaattgtcttggtatccttgttgacctctcatctgtggccccattcctggctctagattctctccttcatttttcatttatccaaggatctgtgagtttagttaagtcactttctaaggctgctccttttgcccatagttctctcccattagtcaaaaatagttattgaacattatttattgagtgttccagtaaatgatagggcaatgaacacacacagtgtccctactcttgtggtgttacggtataaaatacttcagagtttgtagatgaaacttaatttttttggctggtcttttcttagaaaccagtatttaaaaatctgaatatcaaaaaaaa

SEQ ID NO: 381647 - DNA, 400 bp, Homo sapiens
gacacaggtttaagatttttagttgttgttaagacaaagttaaactaattcgttctagatgctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttcccctaatgattggattttaaaatgtaaaattcactttgctctgaaaaaatcctttggttatggctgtgtgtgtaattatttaaaataaagccaaaatcatgtttgagaaaagaatggaattttattagtttaaaattaaaaaatt

SEQ ID NO: 381648 - DNA, 247 bp, Homo sapiens
tgggacccttggggttaatacctggaaccctagcctgttccagctggcccctgggtgccccagttagtcctgtgttctgtgtatacacagccccctacttattggaagaaagctgcaaggcacggagggaaccaaccagtctttaaaatgcaggtatactgtaacagtttgttttcatcagatttccccgagagactagggtgaggaagtggtaaggcctggtgtctcctggagtttctttacacca

SEQ ID NO: 381649 - DNA, 1924 bp, Homo sapiens
ttttgacttataaacaatgctgcaatgaaataattgacatatttccttgtgtacatgtgagcatttcttgagatatgtatctagaacttgaatcactggccaacaggatattcttaatcttcagtttcaccagatacttccaaattgatctccataacatgcataccaaattatattcctaccagccatttataggagttcacattttttccataccctcccaatcctgccttggcagatatgttttttccaatgaataacaatgaaattttgttttgggatttgacaaaatgattctagattcatctggaagaaaagcaagtataagtaagaaatttaaaagggacctgaaaaactaagcaatggatatatttaaaaattggtaccagtagggataaccaaatatttgttaactgtagcagaaacaatgcatgtttttctcactggttccaccttctatctctcagtcaagccctgcccaggtgtggtagtcctcatagtctctcactgtaggggtcttctcacatagtagaccactctcttgagttgaatattgaaaagaaggcttggccgggggcagtggctcatgcctgtggtcccagcactttgggaagctgagtcgagcggattgcttgaggtcagcagttcgagagcagcctgactaacatggtgatgaaaagtacaaaattagctgggggtggtggcgcatgcctgcaatcccagctactcgggaggctgaggcacgagaatcgcttgaacgcaggaggcataggttgcagtgagccgagattgcaccactgcactccagcctgggcgacagagcaagatttcgtctcaaaaaaaaaaaaaaaaaaaaaaaggcttaagtccaactaactgtttccctgctgttcattttatccaacggctggggatataggctactgcacatgatgggttgatggatgtgaaatgataactcatgactttaattctaatttttctatattctggtgaggttgagcatatttttacaagttcataatccattttcctctgatgggagttgcctgtttgaatcctttgcccacttgctttttggggttatttgcaattttttgcattgatcttcaaacattcttaattaatcccaggtacatattattttatatataagatatattttagagatatataggctgatagtatcttttctcagtctaaggcttatcttttaattttgtttatggtgttttgtgtgtgttgttttgcagaagttttattgtatctgaattgtggcttttgtgtcttaagaaattctttacctactgtcataaaaatttttgtctaaaaattttatgattttgcctttctatttatcttgttaattcactttgaaattacttttgtttatggcataaagtccattattttccatatggataatcagttgtcttagcagtttattgaatggtccaacgtttccctgctgattataatgccctctctgttatttatcctaaattcttgacatccggtaaggaagtctcctctgcccacccttctctgtatttcaaaatggttttgactgttcttgaccccttgctctttctgtgaactttaggattaaatgattatgtagaattaaacaatcgggttaaggttttttattagaattacattgaatctatagattaatttggggaaagaatgttatctttctatccatgataattctgtatctctccattaattcaagtctttaatggtttttaaaaataaattattgtctctttgaaaatccttacacatcctttattgcactgattcgtatgtagtttatgtttttgttgttgctttggagaataggcttcttaaaattaaatgtttaaattgatcaatgctggagtatataaatgctattgatatttgtaaaatgattttg

SEQ ID NO: 381650 - DNA, 676 bp, Homo sapiens
tgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttga

SEQ ID NO: 381651 - DNA, 2743 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381652 - DNA, 412 bp, Homo sapiens
ggtctgtgttgaaacgtcaccttctcccctatcttccccccaccccgaggtgcacactgaccaccctgctgccaccacggcgccgtccgcacacgcacaccctcccgctctcagttctcgcactgctgcttctgtccagagtcctttatccttctgaccggttgcgtagtgtgctggtcttttcatggcttttgtgggttttgtgtatttctgctcagctccgtcttgccagaattaccccgaccccctccccgaagctgccggagccctctgtcctgtgagtccccagggcatgggcccctcaggggtgggtggcagatgtgggttaccaagcactgtaccgtgtgatcctgagtgagacaagtacccactggggtctggttcctgccgccagctccatagagcctagtgc

SEQ ID NO: 381653 - DNA, 1937 bp, Homo sapiens
tacggttgcggctggggttactcggccgagggcgcctctagcagcaaacacagagagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381654 - DNA, 2516 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtggtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381655 - DNA, 953 bp, Homo sapiens
tggcttaggtcgaggcctgggttaaatcggccggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381656 - DNA, 1127 bp, Homo sapiens
tggggtctgcgtgcgggccgggccggcccctgacgcgcgctcctcccctgccccagcaccctggagggcggcccctcggcccgcaggcagcggtggcagcgggacctcaacccagaacctgagccagaatcggaagagccagacggaggctttaggacggtgcgatcccacccctccgtcggggctttgcctgctgggtgcccagcttcctggcttccccgcccccccagcatcgccccatcctccacctgaccctcctctacctgacccccagctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381657 - DNA, 2645 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctataaagcacaggcaccacaaataaaagtcgtgaagttgccactcaa

SEQ ID NO: 381658 - DNA, 4371 bp, Homo sapiens
gttctcagtggccaccctgcgctaccctctcccagaacctgagctgctctgacgcggccgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctcttcagactgagccccgttcccctgcatccccgttcccctgcatcccccttcccctgcatcccccagaggccccaggccacctacttggcctggaccccacgagaggccaccccagccctgtctaccaggctgccttttgggtggattctcctccaactgtggggtgactgcttggcaaactcactcttcggggtatcccaggaggcctggagcattggggtgggctggggttcagagaggagggattcccttctcaggttacgtggccaagaagcaggggagctgggtttgggtcaggtctgggtgtggggtgaccagcttatgctgtttgcccaggacagcctagttttagcactgaaaccctcagtcctaggaaaacagggatggttggtcactgtctctgggtgactcttgattcccggccagtttctccacctggggctgtgtttctcgtcctgcatccttctccaggcaggtccccaagcatcgcccccctgctgtggctgttcccaagttcttagggtaccccacgtgggtttatcaaccacttggtgaggctggtaccctgcccccattcctgcaccccaattgccttagtggctagggggttgggggctagagtaggaggggctggagccaggattcttagggctgaacagagaagagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggctgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtactgggcaggtccttgaaagggaaaggcccattgctctccttgcccccctcccctatcgccatgacaactgggtggaaataaacgagccgagttcatcccgttcccagggcacgtgcggccccttcacagcccgagtttccatgacctcatgctcttggccctcgtagctccctcccgcctcctccagatgggcagctttggagaggtgagggacttggggggtaatttatcccgtggatctaggagtttagcttcactccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtgtgacagcctggggcccaggcacacaggtgtgcagctgtctcacccctctgggagtcccgcccaggcccctgagtctgtcccagcacagggtggccttcctccaccctgcatagccctgggcccacggcttcgttcctgcagagtatctgctggggtggtttccgagcttgacccttggaaggacctggctgggtttaaggcaggaggggctgggggccaggactcctggctctgaaggaggaggggctggaacctcttccctagtctgagcactggaagcgccacctgtgggtggtgacgggggttttgccgtgtctaacaggtaccatgtggggttcccgcacccagatgagaagccccctcccttccccgttcacttcctgtttgcagatagccaggagtcctttcgtggtttccactgagcactgaaggcctggccggcctgaccactgggcaaccaggcgtatcttaaacagccagtggccagaggctgttgggtcattttccccactgtcctagcaccgtgtccctggatctgttttcgtggctccctctggagtcccgacttgctgggacaccgtggctggggtaggtgcggctgacggctgtttcccacccccaggcctgcattgatgagaacctggaggtggtgcgcttcttggtggagcagggcgccactgtgaaccaggcagacaacgagggctggacgccactgcacgtggccgcctcctgtggctacctagatatcgccaggtgaggcaagggagggccgggcaggacctggtcggggtgggggcctggaccctcagccctgaccagcccccacccccaggtacctcctgagccacggggccaacatcgccgccgtcaacagtgacggggacctgcccctggacctggccgagtcggacgccatggaggggctgctgaaggcggagatcgcccgccgaggtgggctctggtgtgctgtgtgtggggtgggggacacctcctcacccgtggtctccaggctgagagctttagaggcggcctgggcaccgaggctgaccctgcttcctaggattgtctttctttgtgcctcagtttcctcacctgtgaaatgggggtgtaggggcctgcctccaggattgcttggagcccagcacacgcacaggatgagaactcaaacccctaccaactgggactgtcaatccccctgagtaactgaggggattggaatgccggggcggggtgggtgggtggagggactcacccaggagtgcgttaggtaggattgctggaaccctgccgcaggtctttctgggaggggatgcgtttacttgggggggagtaggggcatgcaggggttgccagggactggtctccctgtcctctgagactcatcgtaccccaggagccttcatatggggtccaggagcccctgaaactgtgtctggccaggttcatttttctagggaaggggtgttgcttctagcaggtgtgtgatggccacacaggatccctgggtccccagcatgtcttctaaagtcctgggcttgcctcccagctctgcctgtgactggtgactccaggcacgtccctgaagcttgcttccctgatttcctaaaacaggaccactggtgccgcttcatggggtggttgtcagggtctggctgggttggagtggaagggtgtgagcatggttcccggcagactccaggggaccgtgtggaaggaaagggagactgacgaggaaatgagataccggcagcctccgagacttctgacgcggctgtcctgacggggccgctggccaggctgaaaggataggattccgcgtgggttcaggggtccacgagagccatgcgggaggactagctagtgggacacgtgacggcggagatctgaggttcgggagcccctctttggttgaaatggggagtgggtcaaatcagccctggacctggattctgtctccttcctcctccaactttttattttgggaaagcttcagatttacagaaaagttgaagcaatagcatgtgactacccatatgactttcactaagattcgccagtgctttttcttttttgtttttgttttttagacagctttttgagatgtaattcacctaccctacaattcacccaaagtgcacacttcagtgctttttagtctattcacggggtcgggcatttatgaccacattggttgtagaacattttcatcatcccccaacgaaaccctgcaaccgcatcacccttcgggatcctctagacgacctcagcatca

SEQ ID NO: 381659 - DNA, 2926 bp, Homo sapiens
ctgcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381660 - DNA, 2149 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggagctctgtgtgtcgtctgagcagtcgcgagaagatttccctccaggacttgtccaaggagcgccggcctggtggggctggggggccccccatccaggacgaggatgagggggaagaaggtcccaccggtgaggggcctgaatctggactcctgggtccgagggaggaggggtcgggttctctgaatctagaggcaactggcatcttctgtgacctgcccggtgttcccacatcacagaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381661 - DNA, 1783 bp, Homo sapiens
ggtctgtgttgaaacgtcaccttctcccctatcttccccccaccccgaggtgcacactgaccaccctgctgccaccacggcgccgtccgcacacgcacaccctcccgctctcagttctcgcactgctgcttctgtccagagtcctttatccttctgaccggttgcgtagtgtgctggtcttttcatggcttttgtgggttttgtgtatttctgctcagctctgactctgttgtggcccagataatttgtttctttcactcacggctgcatctccagtgccggcacacaatgcacctgggtaatgtttgtggaatgaatgaattgatgcagtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381662 - DNA, 3226 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaaaacatacaaagcacaccacctcgcacggccagggtgggtccgccacggtccacgcaggccggcatagctacatctgggccgcgcactgtgcgacagcccgaaaataactccagggtccgccgtgatgttccgctgaggcagcgtggtggctcgtatgatctattgtgggggtaccggcagcggggaaaactaggtggattgccgggaaggatttttaggtgcgcatagtgggtcgtatatcctgatcacttacggcgcggttaaatggaccgtcgtggttttgcggtctagtagaggatagcttgtggacggccactcagtgataacgccacgcatgcatactagagaactgatcagggcactgtactggagactatacacccgatagtgaacacactataaaatcccctttacgaggatgcaccatattacgcattgagtcgaccattacgtctgtcccgtcgtagaaagcccttgacgctt

SEQ ID NO: 381663 - DNA, 1437 bp, Homo sapiens
caggtacctcctgagccacggggccaacatcgccgccgtcaacagtgacggggacctgcccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 381664 - DNA, 1211 bp, Homo sapiens
tcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccagatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaa

SEQ ID NO: 381665 - DNA, 502 bp, Homo sapiens
  misc_feature (494)..(494): n is a, c, g, or t
agtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctatgttccaggttctcctcatctgactgccgacagccctcccacctcctaataaaancggggcca

SEQ ID NO: 381666 - DNA, 1453 bp, Homo sapiens
agattatggaggtgtgaagacaattacggatccctccagctagttctctcagcctcccacagcagcccaactcctagagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaa

SEQ ID NO: 381667 - DNA, 1147 bp, Homo sapiens
agattatggaggtgtgaagacaattacggatccctccagctagttctctcagcctcccacagcagcccaactcctagagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttg

SEQ ID NO: 381668 - DNA, 159 bp, Homo sapiens
aggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctc

SEQ ID NO: 381669 - DNA, 606 bp, Homo sapiens
cccccccattcccatcgatatgttatccaacaccccccacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttg

SEQ ID NO: 381670 - DNA, 1323 bp, Homo sapiens
tcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaa

SEQ ID NO: 381671 - DNA, 1992 bp, Homo sapiens
agattatggaggtgtgaagacaattacggatccctccagctagttctctcagcctcccacagcagcccaactcctagagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagcggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaa

SEQ ID NO: 381672 - DNA, 1378 bp, Homo sapiens
agattatggaggtgtgaagacaattacggatccctccagctagttctctcagcctcccacagcagcccaactcctagagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagcggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaatacaaaaaagttaccggccgctgtgggtgcctgtagtcccagctactcaggatctaac

SEQ ID NO: 381673 - DNA, 1111 bp, Homo sapiens
gccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381674 - DNA, 1103 bp, Homo sapiens
  misc_feature (34)..(34): n is a, c, g, or t
gcggcccctactactactaaattcgcggccgcgncggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381675 - DNA, 1564 bp, Homo sapiens
agacatcgagggcggaagtgggtgtggtcttcggtccgaaggcctggctgcggggagtgggtgcggcgggagttggggtgatcgttaacatttagactggagctgtttccctggaggtgcgcccttgggaagggcctgactgtgtgaagagtggacagcagtcctccgccccctgctgggctcgcggtaaagtggtggctcctgtgtccccgctgttccgcctgtgcactggccgactttttaaagccatgccccaaagtgctgtcctcctgcaaaaccgagcccgaagggacagtgcaaagtgaagtcaaactgagtatttacctgggtaggacgccaaattatttgaaaataaatactaaaaacgttagtataaattgaacctagcttcagctagaccaggcaccaggtgtgtaaatcggtacaccttttaaaatagcagtcaggttctgtttgcagatgaccaaacaaatctcacccttaccctttgactctctatcctgctgctagagatgtagcctaagaaaataatcagatgcacccaaagagctttgcacaaggatattcatgggagcccttatggttttgaagcatatttagtggtcgggaagagtgctcatgatgcgaagctaactgaactatatatacagaatgatccagactttgaaaggaaaaactaaagaaatacatctacatattaagtagtgcatggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381676 - DNA, 1341 bp, Homo sapiens
  misc_feature (20)..(20): n is a, c, g, or t
  misc_feature (168)..(168): n is a, c, g, or t
tctggctacagcgaccctgntcttaggcaaggggaacatttctccctggagagtcaggtcctatcctgtgctgccctgtctgcccagcccagggcgatgcctggaagccaactgacattgcagggagtcagcctcgcccccacccccaactggttttccaatgttttnactggagggcaaaattttactactactcatctttttggagaccagggctgccctgctggcagcctgccttctaagtgaaatcgactctgtttccccactttaaccccaaattggggcttggaccaagggaggtgagaccccctcccccaggtcccctcccctttcaaaatccatctcattttgccacttcatgcccctgccctaactgggtttttgttcattttttaaaaacagaccacccatcccatccgttttggcttcttgtcccctgtaaatagaccatgacttcgatcagtatttcttgtccccaccccttcctagccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381677 - DNA, 1181 bp, Homo sapiens
agacatcgagggcggaagtgggtgtggtcttcggtccgaaggcctggctgcggggagtgggtgcggcgggagttggggtgatcgttaacatttagactggagctgtttccctggaggtgcgcccttgggaagggcctgactgtgtgaagagtggacagcagtcctccgccccctgctgggctcgcggtaaagtggtggctcctgtgtccccgctgttccgcctgtgcactggccgactttttaaagccatgccccaaagtgctgtcctcctgcaaaaccgagcccgaagggacagtgcaaagtgaagtcaaactgagtatttacctgggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381678 - DNA, 958 bp, Homo sapiens
cagagctctgccagaaggactcagcaggttaagagtcgcaatactggcattctctaatttattaaaacaagcctctgagtagcttagtggcttctgccttcataggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381679 - DNA, 838 bp, Homo sapiens
  misc_feature (34)..(34): n is a, c, g, or t
gcggcccctactactactaaattcgcggccgcgncgaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactac

SEQ ID NO: 381680 - DNA, 1047 bp, Homo sapiens
gccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgccattcaagcttggccacaaaattaagccccggtttttttaaggtttattaccaggttaaaaaaaaa

SEQ ID NO: 381681 - DNA, 1298 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagac

SEQ ID NO: 381682 - DNA, 1381 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaaggtgagtgtgatctattgggggagggggcaaggcagaacaggcctcttcccaccttcccgcccctatgtcccctaacctcctagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagac

SEQ ID NO: 381683 - DNA, 1217 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcagggcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagac

SEQ ID NO: 381684 - DNA, 898 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagtgcgggcagggcagggacacgggcggatggcagggacagacaccggggcagaggcagacacgctgggctactgggctagaagacaagagggggtggggggagc

SEQ ID NO: 381685 - DNA, 437 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagcagctctgtcctgttaggccaactgcctccttgccagccccacccccaggtttttgcccatcctcccaatctcaatacagcctgaataaaccaagacaagac

SEQ ID NO: 381686 - DNA, 127 bp, Homo sapiens
ctccattcagtgacctcacagccattaacccttctggctcgtaggtggtggttgggaagcgatctccccagggacactggcagctggacccagcggaccttcaatttttacttcccagggaaggaaa

SEQ ID NO: 381687 - DNA, 1618 bp, Homo sapiens
  misc_feature (1384)..(1384): n is a, c, g, or t
  misc_feature (1388)..(1388): n is a, c, g, or t
  misc_feature (1403)..(1403): n is a, c, g, or t
  misc_feature (1408)..(1408): n is a, c, g, or t
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaaggtgagtgtgatctattgggggagggggcaaggcagaacaggcctcttcccaccttcccgcccctatgtcccctaacctcctagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacaanaaanaacaaaagaaaaaangaaanaaaaacgaacaaaaacagagggcgggccaaccctaacacgaggataacccaccgaacagggcgccaacacacgaacacagaagcgccacagacaagcacacaaagagaacaacaggaggccacaacaacacagagagagccaaaaacaaaagacaaaagactcgcgcgcaagagagaaaaaacagggaggaacaaagagaaacagacaag

SEQ ID NO: 381688 - DNA, 1248 bp, Homo sapiens
ctcgatctgcgcggcttcctgcctccatgccactccagactgcaccggcatggcactgactgcccacccctcctggtggcaggcctagcccaaggcatcagaggcccccttagggcccaggacctaggtccccagccgctagagctgaaagaggccttcaattcaaccggagttacctgagcccagaagagcatgctcaccgcctggacatctttgcccacaacctggcccaggctcagaggctgacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccggcgccatctcacccatcaaggaccagaaaaactgcaactgctgctgggccatggcagcggcaggcaacatagagaccctgtggcgcatcagtttctgggattttgtggacgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagac

SEQ ID NO: 381689 - DNA, 676 bp, Homo sapiens
ctcgatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagaaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagac

SEQ ID NO: 381690 - DNA, 1368 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctctcacacaacccacgatgcaacaacgcgagcaccacaccacacctatacacaaccccacaaacagcccaggcacccactcatacaaccctccccacacaccacaccccatacaaccaaccaccacgttatcatccctgttctttcacacccgcctctgtgcaacccaccccaccctacccagcccccccacttaaaaccacccacacccatacaccccacacacccactataaccccccccaca

SEQ ID NO: 381691 - DNA, 609 bp, Homo sapiens
  misc_feature (8)..(8): n is a, c, g, or t
  misc_feature (18)..(19): n is a, c, g, or t
ctcgtgcnaattcggcannagcgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381692 - DNA, 327 bp, Homo sapiens
ttagccaggtagatgcgggagatggagccgaaaggccggaagagctcctgcaggtcggtctcacgcgtgtcctctgacaagttggtgacacggatggtggcgttgtagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381693 - DNA, 1183 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctcaaaaaaaaaaaaaaaaaaaaaaaaaaaaaaaaaaaaaaaaaaaaaaaaaaaaaaaaaa

SEQ ID NO: 381694 - DNA, 2406 bp, Homo sapiens
  misc_feature (2400)..(2401): n is a, c, g, or t
  misc_feature (2403)..(2403): n is a, c, g, or t
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctctctacttggttctttttgttcttgcgtctccagtcctgtggcgggggccagtgcctcccctcctctgggcgtggtctggtccctgaccctgcagggagccctgtggccagcgctgtgggtgggaaaggcgactgctcctgcctgggctgcagctgggcctgacctggctgcaagcacaggtgttgctttttgggggaagggatgtgtcggggctcgggccctgccctcagggttctccagcaacacctagggtgaggaggcagcttccgctaggccacatcattggctcagctcacgggactggggctctgacggtttaggggcggctgtggcattgaggggcagggcttggccagtgctcttggcgtcctctgggttccagctgtccctgtagccggggcagtgtcggcagcagcagcccaggctgggcactgcggccatgtagagtagagggtggacacagaaggccaggggcatgaggtaggcggccagcgggggcagcgtcagggcgcagagcaggtcgctgactgccagctggacagagaagaccacggcggggtgccatgggcgctgcttccggatgctgaagcggtacagggccaggccattgctggccacggccaccaggaactcaaccaccagtatgggccacaggaagtccccctggaacccactgagtttgtcgtcggcagctgccaagaagttggcagggcaggacttggcacctgtgggcagaaggtgtcaccagctgagccctattcccccataaggcggctcctgctaccccaagagcccacgtctgccatggcgtggatccctggacacgagttctttcccctccctggagggggaccgggctccactcctttatgtggacaggattgaggctcagagccagggttatgcattgggccccaatggaccagcttaggcgggccaggcagtcttggagctcaaggtccactggtaacacagacagcggccaccctactcccccaccacacctggccccactagaggcctcctccccaaagtccagccccagcaaggcctgccggctccacttcagatctgtgccgtccaaagccccgtgggggtccagcccccactctgccctgaccttggcacccgccgccgcccaaagcctcttctccccgtggccaccagagagcacccgcgagcgctggagtcctgccccatccttttgcttccaggtgctcacacttggccagggagttgccgccaaaaagccagactcaccccacaaggtccccnngngcc

SEQ ID NO: 381695 - DNA, 1074 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcaggaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381696 - DNA, 1103 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactgagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381697 - DNA, 1319 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggaggtgtgggggtgggagggtcctgctgtcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcgctgttcctgttgtgtgtcccatgtctgccgttgctgtgcatgtgaggctgccgcccctgttgtcctcccgccctctctgaggaggagggggaggacgacaaatgtgtcaccagcgagctcctctaaggggatccctctggccacaagttgacaccagcccagagccagagctactgccgggaggtgagtgaggactgccgggaggtgagtgaggactgccactcggtgtccggctgcctctccc

SEQ ID NO: 381698 - DNA, 2603 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaaggtgaggctcttcttccccagggctaacctagaggaattggaaaaccgtgctcccggactttgtgtttagagatggggcttaactcttttttttttttttttttgagacagagtgttgctctgtcccccaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctggtctcgaactcctgacctcacatgatctgcgcacctaggcctcccaaagtgttgggattacaggtgtgagccatcgcacccggccaggcttacctctttgtacctattttgttgaagctgaactgaggcctggggtgcttgcactgtcttggggccctgaaaagtccaaggcacagcagtcgataaatagcaactaaataaatgatgataaatatctaatcaaagttcgatgatagatatcaaattatattaataaatatcaaataacatcgattgtaaattcgaataaaaattagattcttttaatttttttaaagacacagtgtccagttctgttgcccaggctggagtacagtggcacgatcatagcttactgcagccttgaactcccaggctcaagccatcctcccaccccaccctcctgagtagctgagattacaggtgtgcactgccacaccggctaattttaattgtttgtagagatggggtttcactatgttgcccaggctggtctccagctcctgggcttgagagatctcccaccttcgcctctcaaagtgctgggattacaggagggagccactgcgcccagccacggttagattcttattcctcttggcctgtcaacctgcaggaacggaagcaggaggtggtcgcagcagtttttggaagaagcgttagcaataagtatacttagaacagcttgctgtgcacttaattgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381699 - DNA, 906 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381700 - DNA, 2379 bp, Homo sapiens
  misc_feature (2373)..(2374): n is a, c, g, or t
  misc_feature (2376)..(2376): n is a, c, g, or t
ccctttttttatgatggattatttggtgtattgacgatgtgtgatttgatgtagtgttttgttgtttttaacagtcccccggctggttttgaggggacagtcctttattgtttttttccaaaaccgggcagaggggtggcagctcttgtgcctggggtccctgccagtccgtggaccaggcctggagactggccatctggctccgtgcccgcttcgtcctcacattaccccgtcctctgcccacccacccccaagatgccacttgggtgtctggggtcttggggtgcccccagaagtcttatacctgccaccctcccctaccccaggccgtccaccaactaagccagctgccactgtgtactcggtccgggacccttggcgacagaagacagcctccgagagcgcgggctccaagggcaataaagcagctccactctctctacttggttctttttgttcttgcgtctccagtcctgtggcgggggccagtgcctcccctcctctgggcgtggtctggtccctgaccctgcagggagccctgtggccagcgctgtgggtgggaaaggcgactgctcctgcctgggctgcagctgggcctgacctggctgcaagcacaggtgttgctttttgggggaagggatgtgtcggggctcgggccctgccctcagggttctccagcaacacctagggtgaggaggcagcttccgctaggccacatcattggctcagctcacgggactggggctctgacggtttaggggcggctgtggcattgaggggcagggcttggccagtgctcttggcgtcctctgggttccagctgtccctgtagccggggcagtgtcggcagcagcagcccaggctgggcactgcggccatgtagagtagagggtggacacagaaggccaggggcatgaggccccgcatcacctggtagcccacgtagggccccagctccagggctgctgtggcctgggctatgtctgcaaagctcgggcagcgggtgctccagcgccgccgagcatccacgttgagcacccgcatgatgtggtagggcacataggagctggcgtagagggccacaccactggccaccaacgctgccacacgcagcttctcggccacagtcatgcctgggctgcgtagcacggcccgcccgagggcgccgtaggctgccagcgtgagcagcagcggcaggccgcagcccaaccccgccagcaccaggctatacgctctgtaggccgccagcccgtggtctgctgtccccagacacttgatgcaggcctcgggcctggccacgctgcagttgcccgccccctgctgcggcctcttcaggtgggagaagctgagtgtgggcatggccagcagggcggccaggacccagccggcagcgctcacggcccaggcgtgcttgggtcgcaggtggcttcgggcgaagaaggggtgcacgatgcccaggtagcggttgaggctgatgcaggtgatgaagatgacgctgcccagcaggttgcaggtgaagaggaagcgctccaggcggcacgcggcctccccatagcgccagtgcttggggggatagaggtaggcggccagcgggggcagcgtcagggcgcagagcaggtcgctgactgccagctggacagagaagaccacggcggggtgccatgggcgctgcttccggatgctgaagcggtacagggccaggccattgctggccacggccaccaggaactcaaccaccagtatgggccacaggaagtccccctggaacccactgagtttgtcgtcggcagctgccaagaagttggcagggcaggacttggcacctgtgggcagaaggtgtcaccagctgagccctattcccccataaggcggctcctgctaccccaagagcccacgtctgccatggcgtggatccctggacacgagttctttcccctccctggagggggaccgggctccactcctttatgtggacaggattgaggctcagagccagggttatgcattgggccccaatggaccagcttaggcgggccaggcagtcttggagctcaaggtccactggtaacacagacagcggccaccctactcccccaccacacctggccccactagaggcctcctccccaaagtccagccccagcaaggcctgccggctccacttcagatctgtgccgtccaaagccccgtgggggtccagcccccactctgccctgaccttggcacccgccgccgcccaaagcctcttctccccgtggccaccagagagcacccgcgagcgctggagtcctgccccatccttttgcttccaggtgctcacacttggccagggagttgccgccaaaaagccagactcaccccacaaggtccccnngngcc

SEQ ID NO: 381701 - DNA, 1313 bp, Homo sapiens
gtcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacacgcacgcctacacacgcatacgcactgcacgcgactgcgcacacgcacaccctcccacgccactctgctccgccaccctctcagcgcactctgaccaccccgcgcacccgcctccaccaccgcgccgcctccccaccgcgcacccaccccacactgcgcaaccaccctctccgggcaactcacgccagctctctgcaccccacccgcgcacccacactgcctgcgcccacccacccactgcctcccctgcacccacctgctctcctacctgcacgctccactcacccacccccccgccacgcgaccctgcacaccctgccacccaccgaggcacggacccctctgcaacacacacctcaacgcggccccgcacgcactcgtgctccatgcccgcactctgcccccggccccaccccctggcaccaccccgcctgcccccttacaccggcattacgcctgcggcgccccctgccccccacgcgcagccttgccccgccccccgcctgcggccctgctctccctgcgccccgcaccgcccccccctccccggccgcaaccctcccccccgccgcccggccacccccccccaccccccacccacccctgctccccccccccccctgcccccaccgcccccagcccgccgcgccgcacctccccgtcagccccaccgccccacccgccacccaccccaccaccccccggtcccccacttcgccacacccacacccccgtcaccaccgccccctccccgcagcccctccccgccctctccggaccccccctcccgcccactccccgcgccctccgcgcccccaccccccggcccctccccccccccgccctcccccctccccgccccccaccccccccccaccccccccccctgccccaccccccccccccccccccccccccccccccccccctcccccctccccccccccccccccccccccccacccccccccccccacccccccccccccccccccccccccccccccccccccccccccccccccccccccccccccccccccccct

SEQ ID NO: 381702 - DNA, 438 bp, Homo sapiens
ccctttttttatgatggattatttggtgtattgacgatgtgtgatttgatgtagtgttttgttgtttttaacagtcccccggctggttttgaggggacagtcctttattgtttttttccaaaaccgggcagaggggtggcagctcttgtgcctggggtccctgccagtccgtggaccaggcctggagactggccatctggctccgtgcccgcttcgtcctcacattaccccgtcctctgcccacccacccccaagatgccacttgggtgtctggggtcttggggtgcccccagaagtcttatacctgccaccctcccctaccccaggccgtccaccaactaagccagctgccactgtgtactcggtccgggacccttggcgacagaagacagcctccgagagcgcgggctccaagggcaataaagcagctccactctc

SEQ ID NO: 381703 - DNA, 640 bp, Homo sapiens
tgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggtaagcggggcaatcaggtggggctggcatcctggggtggggcaaagggggtgccttagccgcctctgagctccc

SEQ ID NO: 381704 - DNA, 427 bp, Homo sapiens
ccctccagggaggaagttgtaatctcccgtctcctgtttctctactggcgcctggttggcttcatggcctggcacccaccttcctacgagggatctcccatccttgccactccgagtccccacagggccatcccagtgcgttgcctggccagccctctgcccttggcctgcctttctccgcttttgctgtaggcgtcatcccaaaagcccttccatcgcagctggggagctcctgcccctggagctgactcctccttcctacgctgccttttgcagacaaatgtgtcaccagcgagctcctcaaggggatccctctggccacaggtgacaccagcccagagccagagctactgccgggaggtgagtgaggactgccgggaggtgagtgaggactgccactcggtgtccgggctgcctctccctccag

SEQ ID NO: 381705 - DNA, 1125 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381706 - DNA, 718 bp, Homo sapiens
gtgcgcagtgtaccaccacgttctgttttctcggttaggaagtccggttttcgggttttggtttcagtcataggggcaacacgtaaggggtttcaaggtacctcacaggtaaaataaagtattagctcagttccctgaagacatttgccaaaagaaggtttaaaaaatcaagtgagggaactatattaagcctctgtgccgcctggccgagcatctgggcccgtttactggcgagaaggagaaacttccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381707 - DNA, 850 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagtggcttagaaaaaaacaacaacacaacacaaacaaaaaaaaatgtttgcgggccgactggggccccggaaaagcgcttcctgaaacaattcggcgtgtggggcccgggggccccgtgggtctaccggtgcacaggtggcacaacaggcggtccccgaggagaaaaaccggggcgcagaaacaaaaggcgggcacggaaagtgcccacaccaaggtagaaagaacgaccgcccggggggggacaccagaggagcggtttctgagacaacaacactcgaacggcggcgaaccctccagagggagacactagagcggggcagacaaatcaccgcggggggaggctcacaagcagaaggcgtggaaattacaaaattagccgggg

SEQ ID NO: 381708 - DNA, 3066 bp, Homo sapiens
  misc_feature (3060)..(3061): n is a, c, g, or t
  misc_feature (3063)..(3063): n is a, c, g, or t
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctctctacttggttctttttgttcttgcgtctccagtcctgtggcgggggccagtgcctcccctcctctgggcgtggtctggtccctgaccctgcagggagccctgtggccagcgctgtgggtgggaaaggcgactgctcctgcctgggctgcagctgggcctgacctggctgcaagcacaggtgttgctttttgggggaagggatgtgtcggggctcgggccctgccctcagggttctccagcaacacctagggtgaggaggcagcttccgctaggccacatcattggctcagctcacgggactggggctctgacggtttaggggcggctgtggcattgaggggcagggcttggccagtgctcttggcgtcctctgggttccagctgtccctgtagccggggcagtgtcggcagcagcagcccaggctgggcactgcggccatgtagagtagagggtggacacagaaggccaggggcatgaggccccgcatcacctggtagcccacgtagggccccagctccagggctgctgtggcctgggctatgtctgcaaagctcgggcagcgggtgctccagcgccgccgagcatccacgttgagcacccgcatgatgtggtagggcacataggagctggcgtagagggccacaccactggccaccaacgctgccacacgcagcttctcggccacagtcatgcctgggctgcgtagcacggcccgcccgagggcgccgtaggctgccagcgtgagcagcagcggcaggccgcagcccaaccccgccagcaccaggctatacgctctgtaggccgccagcccgtggtctgctgtccccagacacttgatgcaggcctcgggcctggccacgctgcagttgcccgccccctgctgcggcctcttcaggtgggagaagctgagtgtgggcatggccagcagggcggccaggacccagccggcagcgctcacggcccaggcgtgcttgggtcgcaggtggcttcgggcgaagaaggggtgcacgatgcccaggtagcggttgaggctgatgcaggtgatgaagatgacgctgcccagcaggttgcaggtgaagaggaagcgctccaggcggcacgcggcctccccatagcgccagtgcttggggggatagaggtaggcggccagcgggggcagcgtcagggcgcagagcaggtcgctgactgccagctggacagagaagaccacggcggggtgccatgggcgctgcttccggatgctgaagcggtacagggccaggccattgctggccacggccaccaggaactcaaccaccagtatgggccacaggaagtccccctggaacccactgagtttgtcgtcggcagctgccaagaagttggcagggcaggacttggcacctgtgggcagaaggtgtcaccagctgagccctattcccccataaggcggctcctgctaccccaagagcccacgtctgccatggcgtggatccctggacacgagttctttcccctccctggagggggaccgggctccactcctttatgtggacaggattgaggctcagagccagggttatgcattgggccccaatggaccagcttaggcgggccaggcagtcttggagctcaaggtccactggtaacacagacagcggccaccctactcccccaccacacctggccccactagaggcctcctccccaaagtccagccccagcaaggcctgccggctccacttcagatctgtgccgtccaaagccccgtgggggtccagcccccactctgccctgaccttggcacccgccgccgcccaaagcctcttctccccgtggccaccagagagcacccgcgagcgctggagtcctgccccatccttttgcttccaggtgctcacacttggccagggagttgccgccaaaaagccagactcaccccacaaggtccccnngngcc

SEQ ID NO: 381709 - DNA, 1850 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggaggtgtgggggtgggagggtcctgctgtcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcgctgttcctgttgtgtgtcccatgtctgccgttgctgtgcatgtgaggctgccgcccctgttgtcctcccgccctctctggggtggggtcggggctcctcctcctcctcctccaccagtgtcgctggctgggagctcaaatggtgtcagcttctcaggtgtcaccttggtgtcctcgtggccaactggctgcctgtggtttggcacacagtgcctgcgctggctcaacactgaagcccgagcttcctggggcggctctgtccccacgcctgcgccacagtgaggttgaacttgactgtcttttggtccccagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381710 - DNA, 2489 bp, Homo sapiens
gtcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagagtgttgctctgtcccccaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctggtctcgaactcctgacctcacatgatctgcgcacctaggcctcccaaagtgttgggattacaggtgtgagccatcgcacccggccaggcttacctctttgtacctattttgttgaagctgaactgaggcctggggtgcttgcactgtcttggggccctgaaaagtccaaggcacagcagtcgataaatagcaactaaataaatgatgataaatatctaatcaaagttcgatgatagatatcaaattatattaataaatatcaaataacatcgattgtaaattcgaataaaaattagattcttttaatttttttaaagacacagtgtccagttctgttgcccaggctggagtacagtggcacgatcatagcttactgcagccttgaactcccaggctcaagccatcctcccaccccaccctcctgagtagctgagattacaggtgtgcactgccacaccggctaattttaattgtttgtagagatggggtttcactatgttgcccaggctggtctccagctcctgggcttgagagatctcccaccttcgcctctcaaagtgctgggattacaggagggagccactgcgcccagccacggttagattcttattcctcttggcctgtcaacctgcaggaacggaagcaggaggtggtcgcagcagtttttggaagaagcgttagcaataagtatacttagaacagcttgctgtgcacttaattgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381711 - DNA, 2473 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctggtctcgaactcctgacctcacatgatctgcgcacctaggcctcccaaagtgttgggattacaggtgtgagccatcgcacccggccaggcttacctctttgtacctattttgttgaagctgaactgaggcctggggtgcttgcactgtcttggggccctgaaaagtccaaggcacagcagtcgataaatagcaactaaataaatgatgataaatatctaatcaaagttcgatgatagatatcaaattatattaataaatatcaaataacatcgattgtaaattcgaataaaaattagattcttttaatttttttaaagacacagtgtccagttctgttgcccaggctggagtacagtggcacgatcatagcttactgcagccttgaactcccaggctcaagccatcctcccaccccaccctcctgagtagctgagattacaggtgtgcactgccacaccggctaattttaattgtttgtagagatggggtttcactatgttgcccaggctggtctccagctcctgggcttgagagatctcccaccttcgcctctcaaagtgctgggattacaggagggagccactgcgcccagccacggttagattcttattcctcttggcctgtcaacctgcaggaacggaagcaggaggtggtcgcagcagtttttggaagaagcgttagcaataagtatacttagaacagcttgctgtgcacttaattgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381712 - DNA, 2270 bp, Homo sapiens
gtcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagagtgttgctctgtcccccaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctggtctcgaactcctgacctcacatgatctgcgcacctaggcctcccaaagtgttgggattacaggtgtgagccatcgcacccggccaggcttacctctttgtacctattttgttgaagctgaactgaggcctggggtgcttgcactgtcttggggccctgaaaagtccaaggcacagcagtcgataaatagcaactaaataaatgatgataaatatctaatcaaagttcgatgatagatatcaaattatattaataaatatcaaataacatcgattgtaaattcgaataaaaattagattcttttaatttttttaaagacacagtgtccagttctgttgcccaggctggagtacagtggcacgatcatagcttactgcagccttgaactcccaggctcaagccatcctcccaccccaccctcctgagtagctgagattacaggtgtgcactgccacaccggctaattttaattgtttgtagagatggggtttcactatgttgcccaggctggtctccagctcctgggcttgagagatctcccaccttcgcctctcaaagtgctgggattacaggagggagccactgcgcccagccacggttagattcttattcctcttggcctgtcaacctgcaggaacggaagcaggaggtggtcgcagcagtttttggaagaagcgttagcaataagtatacttagaacagcttgctgtgcacttaattgtaacataccccatgccaagcaccttgcacgaagtgtttctcattcagtctccttaggagcccagggaggcaggaagcttttgtggttcccgttttataagggaggaagctgaggctcaggttgtctagctcaagggcccggaggtctaggtggacccctgcacatccctgagtattgcgccctggtgggagctggtccgccagactgcgcaggccccacgctgtgtagctgtcacctggacccggaggctgacagctgccctgcctcctggagctcaggcctggcgtgtactcaggaaacaactgtcgccaggactgttcagggagtgcttgaggaggatgaagatggggtttgaggcccagacactctgggggtggctgttgtaggtctagggcaccccactgtggaacccagcctgcccctgccctcaactgtcccccatccctccctgagcccagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381713 - DNA, 768 bp, Homo sapiens
gaagctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgaccccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 381714 - DNA, 290 bp, Homo sapiens
gttgctagggagtatacctttcctttggtaaaatatgaatttgtttcttactgtttagaataggtaaggtttcttaattgctgataattatattatgtagaacgtctttttggcaagggctgtatttattcactatttgattatacttaaacttcaggctgggcatggtggctcatgcttgtaatcccagcactttgagaggctgaggtgctgaggtgggaggattgcttgagctcaagagttcaagaccggcctgggcaacatagcaagtgagaccccatctcaaaaaa

SEQ ID NO: 381715 - DNA, 432 bp, Homo sapiens
gactataggttaatggtggcgagagggtcagcaggaaaacatgtgaacaaaggactctgtgtcaaaaataagtttaaggaaaggtgctgtgcctggatgtgcacataggccagatttatgtttaactttacacaaacatctcaatgcagtaaagagcagtattgtctccagcatgtctcacctccagccataaggcagttttctcctatctcagttaatagaatgtatgatcgggttttacaccgagacattccattcccagggatgagcaagagacagatgccttcctcttatctcaactgcaaagaggccttcctctttcactaatcttcctcagcacagaccctttatgtgtgtcgggctgggggaaggtcagggctttcccttcccatgaggccatatctcaggctctctcggtggggagaaaccttg

SEQ ID NO: 381716 - DNA, 440 bp, Homo sapiens
gaattcccaacaaacaactctctgtccccctttttcgtctttaaaaacctgcctgtaataaaggccgaatagggctcctatccaagctgcttcagtccgagtcttccaggcagctgccctcacctcagctcaagtcaatctttcagctacattttatgcctcagcctcttccttttaggtggtcaccagcatccctgcagatgggagccagctgcggctgtgtcccgaggcaagggcaggcagtgccttcaggctgggtgagaggggacatctccaggcaggctcctgctctcaggccgagctggccagcatggctggaatgctgatgaggagagcaggagctggactcactgaatgctaatgagaggcagacagcacctccgtgcatggcaggcccgcgccaggccgctctgagggataccctggtcagtaccccagag

SEQ ID NO: 381717 - DNA, 194 bp, Homo sapiens
gtgaaagccaccactggaaaactgcctgaatgtctgctcatcttcatcgccaagaaaataactttaagatctaatgggctggacagttttgtaacagaagttactctgatggcctgttcctaccagtggaagctttactaacaatgtgttgtgttcatgccataaagccgacatgggacctgtgaactcttttc

SEQ ID NO: 381718 - DNA, 383 bp, Homo sapiens
gagagctgagaggctaaaactgggtgaagacttctgcagagaaaatatttttaaagtcataaaaccatgaaaataacaactactgtacgttttattttatagaaatcaagtagtatctaatagacaagggaagacattgatccataaactttttaaagaaaatttggtaatctcttaaagtatttgtatggctttgaatgggtgtgcttttctaactttgttttaatttttatgatacacttataattgtttcaaataggcatttgttcattttaaaactactagaagttacactgaagaaaagcattcaaaagaagacttttgaacaaaaaaattgttgaatgagtgaaatgcctgaagtagctcaatttaccaaacagaaa

SEQ ID NO: 381719 - DNA, 392 bp, Homo sapiens
gctagagtttctcaggaagaataaaggaataactccaggaaaaaatgtgtctgagataatgaacgtattcagtgttaaaaggcaggcaaatagaagaacatgttgcaataaagaaagtagaagaaaactctacaaaatggagctgtagaaaaagtagcaggtgtgtctcagagagaatgagtccattgttgagcagtttcaccccagtgttctacgaagcataaatgaggcctgggcatcaccaggcagctagcacagaagctcattgaaatcaagcagggttgggttcctactctcatgcagacaagtgtgcaaagcatccagccaaatatctgaatttgctttcaggtcaaggcacggatgttcttagataccagatggcccaatactga

SEQ ID NO: 381720 - DNA, 391 bp, Homo sapiens
agaatgttcagtaagatcccatcctgggaagaaaaccctatttaaaaatatatcatatagaatatataaaacatatacacatacagatatagactgtgtgtgttttctatttccatgtagcaaattaccccaaaactgagcagtgtaaaacaacaaaccttcattatcttacagtttcagaggctccaggatttggaagaagcccagtggggtggctgtggctcaggatctggcacgaggttgccgccaggacggcaacacctgcacgtgcgactgggctgggggatccgtttccaaggaagcttgctcacatggctgctggggagaggcctccagtcctcacaaggccattggtggaggctgcagctcctcacaggctattggcgggagg

SEQ ID NO: 381721 - DNA, 468 bp, Homo sapiens
tcggaaattaaaatgcccctgcagcaacctcaacgagttttcttttgctcttagcactctgacagccctaaacacagcacagtatcttccttcccacttctgtcagatacaaggactccaggagcgtgttagttctccttcattcactttcaggtttatgcagaactgaagatgccataattcagaagtgtctgtgtttggcgacggattttagtatcgacattaaactgagaacttccttctttccctgaaggttacccaacaagtgctaatcaaaacctctccatgttctgcctgatttttaccagcttgttcttatttggaccctctgaggcccactttaacaattctgatgtctttattttagaaactcttttacctaaattagatcatgactctctgggggtgtaaccaaattaaaatgttttgccacacagtaagagggtcacaatggaggaaaaaaaggaa

SEQ ID NO: 381722 - DNA, 407 bp, Homo sapiens
attgaattgtaagagttctttatgcattttggatattaggtccttctcagatatatatttgcaaaattttccccccattctgtttttggcttcactttcttgaagatgacttttgaagcacaaaagtttttaattgtgatgatgtccaatctattttttttctttcataacttgtctttttggttttgtaccttaagaaaccattgtctagggtgggcgcagtggctcacgcctgtaatcccagcactttgggaggccaaggtgggcagatcacctgaggtcaggagttctagaccagccttgccaacatggtgaaaccccatctctactgaaaatacaaaaattaacctggcgtggtggcaggcacctgtaatcccagctatttgggaggctaaggcaggagaatc

SEQ ID NO: 381723 - DNA, 640 bp, Homo sapiens
tttttttaagaggggctcctgctctgttaccctggctggagtgcagtggtgcaatcacagctcaccgcagctgtaaactcctgggcttaatcaatcctcagcctcccaattatctgagaccacagctatgtgccaccatgcccagataattaaaaaaaaaaaaaatctttttgtagatacagagtcttgctctgttgcccaggctggttcttgaactcctggcttggagagatcttcccatctcaggctcccaaagtgctggaatttaaggaggaagccactatgcctggccaaatattcacttttatatttaccaaattgatagcacaatttttttgtttttttgagatgcagtcttgctctgtcgccaggctggagtgcagtggcgcaatctcagctcactgcaacctccacctcccgggttcaagcaattctcctgtgatggcacaaattttaaaaaatcagagaaaatcaaattttgatgaggatgctacattacttgtgctctcttacacactactgatggaaatataaattagcatacctgctctgaaaataatttggccttctctaatgaagaaggaggatgtgcagacagactctgtgatacaagaattctaagtatatatatttaagaaac

SEQ ID NO: 381724 - DNA, 346 bp, Homo sapiens
gaggccttggaaataacccaaatgtccaataagggagaattgattaaattacatattatgaatcagtgatgtagataaatatctgacatgaaaatattttacagtgttgtgttagtagtaaaagcaggttttgaaacaatacatgaattaatgtcacaaaaagttattaatatataatatgcttaatattgtattctataatacctaggtattaggtagctttttcttgaaaaggaaggtagaaaaagtttttttgaagttgtcataacagtattagactgcatcatgagatactgtttccttctggcttttggtgaaggtatttgctttttactagttttgtaac

SEQ ID NO: 381725 - DNA, 282 bp, Homo sapiens
atgtcaaagataactttacaagagaccgcgtgaacatagatatataaaggagagcctagtgctctcaatgcccatatctgcaggcctcaaaattgcttatgaagtctagaaaccatggccatctgccagccggaggcagcatcaccacaatggaattcacagtcactctgttaagactttataaatacagtgagggtccaggagccaggaccttcaggcgcatgaggcttgtctggtctggtctggccgactgagcaaggaaaccctgtccttgaatgagga

SEQ ID NO: 381726 - DNA, 465 bp, Homo sapiens
tgtatttttagtagagacgggttttcaccgtgttagccaggatggtctggatctcctgacctcgtgatccgcccgcctcggcctcccaaagttctgggattacaggcgtgagctaccgtgcccggcgtccaaatttttttatatttcttgaaaaatatctgctaacaagagcacccatgcagttcacactatgtcattcgagggtcaattgcatttgtaactcctgtctctgacagtaacctgtctcctttcatgcttagtatgtagtaagtccttacttaacgtggtcaataggtcttggaactgagcttaagtgaaagacgtataataaaaccacttttaccataggctaactgacataaataagagtgacattcctatgatgtatttctggtcacagaaacatcactgaacttctaagtaaggacccaaaacacttgtaacaaacagtaaacattgaaatca

SEQ ID NO: 381727 - DNA, 1846 bp, Homo sapiens
gttaaaaatgaacattttcaggccccactcagacctgagtcagcgctcagtgggagcggagccccgcagtcacgttgtgaccagctcttcaggtgttaggccggttgtcccttcgcgtccttcatagaatctgatccaggaccacacgttgcatttaattggcgtgctctttagtttcctttcttctgtacccccattttcaaggggtgcaggcaagttatcttgagaatgttcgtcaatgtgatgtcgcagccccaccgttgggagtgtacagatggcaacatattttcacacagtgtgtttatgaatgttcagagcaagccttcataatggccaaaaacgaaataattcacagtacatgaactgctagtaaatactatagattaagagatatttagaatttaaaaggaataaatgatatctactacactgtgtatgaacattgaaaacactgtgctaagtgaacgaagcaagacacaagactacgtattattatatgtaattccactcggataaactgtcctttgaaaggcacatttagagacacagagcgggtcaggggctgcacagggctggaggtggcagcgggagcttcggagaagtggagcgacccaaaaccggattgtgggggtcgctgcggaactctgtaaatttgctaaaatcattggattgtacatttaaagggataatcttatagtaagtcaagtacacctcaattaagctgttcttaaaaattgactataaactaacacagcatctcagttagtgccctcagaactggagttgggacccagtagagaggtggaaagaagtgaggcctaagtgcagtgagtttgtttcaaataggtcaatcatcgacgccgttatgttctggaagtaatgaataataaagacgtataaacttaaacgtgttagtgaataccatcactcaatgatatcagtagaaatgataatcttccaaattgttggagagaaaaaataaccatgcaaataaaacaggacaaacagaaccaactctgtttaccagatatggggggtgggggtgggaagtaacattcagaatcgtaaaatagaaaacatagaatgagagaagcctgaatgttacaacagtgagtgcggagaaactgacgtaatgaaagaaaaagactttgagacagggccaggaaaacgctgccgcctacaagcaacacacctaaacggagtgacccagaagggtttagtggcacgtccaggttcgtgtgtgaagaaatagatgggtccccttcagagtttgaagcatgacccatgtgaccagataggagaatctctcgagcgcagggaaagctgggtgctgcctgtgtggtggcagagtctggagggcttgctgtgctggggactaaagagcaggaggactgcaggtgaggcgtgcagacgactttttatcggtaaagattttaatgccatttggtaattttgtcattaacatttattatgatagacaaggcttctagtatctttgtttcaaaactggtttgttccaaagctagagataagaaaattatgcatctcatctagtttcataaaaggaagtttggaggacctgctcccatcaaaacactggaagatgcagagacttttgtcagctcctggctaattagataatgctaatcatgtgagtagcaataaaaattcgaagtcctgccagacgtaggttctagacattctgacagccaactaaagagccagcaataacgtgtgcctaggagtgcgagagccttctccacctccgtgatgcctccgggttcgtgcatggccacttgtgctgcgtgagcgtcgtaggtttaggggaacagaagtagagggattt

SEQ ID NO: 381728 - DNA, 284 bp, Homo sapiens
cttcagtgtcctgagagagattattgggcagtctttaataatgaaaactttaccttgaattacacacacacacacacacacacacacacacacacactcacacacacacacaaagagagagagagagagagagagacagagagagaggagagagtcaagttctagggtgttaagtccaacattatcagctggggcttgggaaccttcaaggttttatgaatgatgaggtctatttgctttcaatactacaagggggaggaatctggatatttatccatgtttta

SEQ ID NO: 381729 - DNA, 1029 bp, Homo sapiens
ctttgcagggccagtgaagcagatactatcaatatgttctactctgtcacattgaattcctttatcattttgaggcacaccagagttcctgatgtcttttctctctcaacactcagcacctcagcctctttgttggagggctgtcctgagactgctagattgttctccttgagtgtgcagtactggaagtgcttggagaaatccttaccagtgactgacacacagcaagggttgcttctggaggacctgacctaagattggcatcttactcagtccagaaggtcagggaagacttcttggaagacatgccatctaaaacaatgactgatggaggaatggaatcatccaagtgtacggggagtggatggaagacaagagcattctaggaaccaaacaagatgctccacaacacccagagtctggaacatccgctactactctatttctgaaggtgccttcagaagattaccacagccttcatcttgtcaagaccccaaaatggtggctttcatcataatcttgcccttcaaacatcgtctctcccccaaaatggcccatttctctctcagatgcacttctagctgattcccacctctatgcatttactcatttgccccttaggccagtttctgtttctacatgcatcttaaaaaattaaaacctccttctcttctccctttccctatggatgtgggctacagtagcttgttcctacgtgcccttgggctcctcctgtaacttcacgctttgcctctttaaatagattgttggtccctcaggggatgtttttatgattcatacttaaaaactgctaaccacaatgtaagaactttctcattttttccctctttactgttaatttaaaacttttgttaccatcacttttatttaaaaatgaaaaatatagaaaacagatgacaaaaataaaaagaaggaaaaaagaaccccaaccgaagaaacgaaaacaagaagtcacgccggccaccttatatacaacaaaaaatggagcctcattggcctaaagcggag

SEQ ID NO: 381730 - DNA, 573 bp, Homo sapiens
ctaggttacatcgtgaggtcagaagatggtaagatcacccagatattcactctgcttcctactggggctccttctcattcctggccctctccccgccggcctgctcttctttccctcagctgtgagctgggtgcacacagctgttgtgtcttgttcacacctatattcctgacagttagcatcatgcctggctgagagttggtgcatatcttaaatgttttcttgaaatttcaagtaagacaaaaaatatcaaataccaaatagtgtataaatttggaagattagattcactgttgcacctgtcatggtggaatttgtcccatgtggctcctgtgggtcaggaatacattgtatcaaaaaatgcagatcctggctaacaaggtgaaaccccgtctctattaaaaatacaaaaaattagccggctgtggtggcgggtgcctgtagtcccagatactcgggaggctgaggcaggagaatggcgtgaacctgggaggtggagcttgcagtgagctgagatcacaccactgcactccaacctgggcaacagagctagtcttaaaaaaaaaaaaaaaa

SEQ ID NO: 381731 - DNA, 431 bp, Homo sapiens
ctaggttacatcgtgaggtcagaagatggtaagatcacccagatattcactctgcttcctactggggctccttctcattcctggccctctccccgccggcctgctcttctttccctcagctgtgagctgggtgcacacagctgttgtgtcttgttcacacctgtaatctcagcacttcgggaggccaaggtgggcagatcacttgaggtcaggagttcaagaccatcctggctaacaaggtgaaaccccgtctctattaaaaatacaaaaaattagccggctgtggtggcgggtgcctgtagtcccagatactcgggaggctgaggcaggagaatggcgtgaacctgggaggtggagcttgcagtgagctgagatcacaccactgcactccaacctgggcaacagagctagtcttaaaaaaaaaaaaaaaa

SEQ ID NO: 381732 - DNA, 404 bp, Homo sapiens
gacacaaactagaaaatttagcggttatttttgcttagctaaaatgtctacataaggcaaagaaaacacatctcttgtgattcatgatttgtaattttcataatttacattagtaactatttgtaacccagttgctttttgagattacaaaacgatacttcaatataaccagtaacagtgtgtacaacacctacaaacagaggttaaaatatagtgaaatatttagaattttttgactaaattaaaagatatataaatattttaggtttggagttttaaaagaagctcgtttttactttttagaaaactaacgcataagctatgacaataatttcactatgtgtgctttgcattccaggatagccttttgtgtcaaaaagcagcaagataggaattaatgctaa

SEQ ID NO: 381733 - DNA, 440 bp, Homo sapiens
gtctttctctcaagtaggccaggcacagtggctcacgtctgtaatcccaacactttgggaggccaaggcaggaggatcagttgagcccaggagtttaagaccagcctggacaacatagtaagaccctgtctctacaaaaatagaaaaattagccaggtgtgtgcctgtagtcccaggtgcttgggaggctgggtgggaggtggccaagaggttgaggctgcagtgagccatgattttgccactgcacttcagcctgggcaacagagcaagatcctgtctcaaaaaaaaaatactgagaatagacacatgaactattcagaaattcaaaagaggcagagcaggctggctcatgcctgtaatttgagcactgtgggagcccgaggtgggggcatcgcttcagttgaggagttctagagtagcctgggcaacacagagaaacc

SEQ ID NO: 381734 - DNA, 4136 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaactcgagactagttctccgctgctccagcctctggggcgcattccaaccttccagcctgcgacctgcggagaaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattg

SEQ ID NO: 381735 - DNA, 406 bp, Homo sapiens
tttgtagacttaacaccttcaattgaaactgtcaattaaagttcttaagatttaggaagtggtggagcttggaaagttatgagattacaaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcacccggatttgccgagtgagcgtggggtcctctagagtcacctacg

SEQ ID NO: 381736 - DNA, 308 bp, Homo sapiens
cctaggttttcgcagtttcaatagcagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcgcagcaatgtgctattgaaatcttctaaaactagg

SEQ ID NO: 381737 - DNA, 407 bp, Homo sapiens
cttgcgaagctaattttaaagaactttttctcttcatcattatacgcaatcgccagtcagtgctatcggggattctccacttccctaatcataaagaggccattggcagtctcaatccaacctttcgtttgagcacttggcaaccagtgtcagcccagcaatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccgg

SEQ ID NO: 381738 - DNA, 147 bp, Homo sapiens
cgttgctgcacccttcccccagcaccgatttctcaccaaatcactacacaggacagcaaaggggtgagaaatcgttgctgcacccttcccccagcaccatttatgagtctcaagttttattattgcaataaaagtgctttatgccgg

SEQ ID NO: 381739 - DNA, 1835 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381740 - DNA, 1834 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgttggggggggggtttgcaagaatatttaatttaattttttggatgaaattttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381741 - DNA, 1613 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccgg

SEQ ID NO: 381742 - DNA, 1691 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccgggttcttccgctacacaccacatcacaactctgcggttttctgtggcgaaaggttgctgggctgtcttgctttctgcct

SEQ ID NO: 381743 - DNA, 1607 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcacccggatttgccgagtgagcgtggggtcctctagagtcacctacg

SEQ ID NO: 381744 - DNA, 2889 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaatgaatgactttgttctaccctgtgtttctagaagctagagggggaaaaaaaaagccctttggatatgaatatcatgtcctagcttctgcggctctctcttcactgtggtttgtggttactgcctattagatggtatgagggaggcattcctgcatcggtccacctgctcagggtccacacccaggacacttgaggcccccaggccagcttatcagtgagtgaagtggaaaaatgaagccagaggatgcttgtgaagttgaaaggatgctcttagatcagacagttctaggaagggatcttaggggcctctgcatcagctttattgtgcaacagtaaggaaacagggccagagagaaaggccttactcaaggtcacatccaggcagtggcaaagtaggaccagagcccctgtttgttgattttcccctcttccaccctcatttcttaggaactaaactcagtatcctagtagcacgtaacttttcatgtaagtgttagaatcattaagtacatgaatgctactggcttccttccaactggccccagacctttttatttgctcccctcctgccataggaaccagagggtcacagccaaggcctgggtgaggacacttttgtttgaaagccacaacaaatggctgccatcctatttgtgatggcagtcagagctacttgtaacctggtcctgttgtgcacatctatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381745 - DNA, 1502 bp, Homo sapiens
aggagaaagtttgtttcacctgggacccagcccaagtctttctggctgtctccagctggaacagaagtggcttggtctcagactgctcagctgttggggaagggatttggcgtggcagatggcatcgtggctgtcgccactgcacacaaagaacactgagttgctggaaactcacagattttctgtccccaacagatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381746 - DNA, 1961 bp, Homo sapiens
  misc_feature (1007)..(1007): n is a, c, g, or t
  misc_feature (1010)..(1010): n is a, c, g, or t
  misc_feature (1018)..(1018): n is a, c, g, or t
  misc_feature (1027)..(1027): n is a, c, g, or t
  misc_feature (1030)..(1032): n is a, c, g, or t
  misc_feature (1039)..(1039): n is a, c, g, or t
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggggaaccagagggtcacagccaaggcctgggtgaggacacttttgtttgaaagccacaacaaatggctgccatcctatttgtgatggcagtcagagctacttgtaacctggtcctgttgtgcacatctatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtaggggggggggtntgnaagaatanttatttaanttnnnggatganatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381747 - DNA, 1472 bp, Homo sapiens
  misc_feature (1152)..(1152): n is a, c, g, or t
  misc_feature (1155)..(1158): n is a, c, g, or t
  misc_feature (1161)..(1161): n is a, c, g, or t
  misc_feature (1167)..(1167): n is a, c, g, or t
  misc_feature (1172)..(1172): n is a, c, g, or t
  misc_feature (1174)..(1174): n is a, c, g, or t
  misc_feature (1179)..(1179): n is a, c, g, or t
  misc_feature (1228)..(1228): n is a, c, g, or t
  misc_feature (1230)..(1231): n is a, c, g, or t
  misc_feature (1234)..(1234): n is a, c, g, or t
  misc_feature (1237)..(1238): n is a, c, g, or t
  misc_feature (1250)..(1251): n is a, c, g, or t
  misc_feature (1253)..(1253): n is a, c, g, or t
  misc_feature (1258)..(1258): n is a, c, g, or t
  misc_feature (1306)..(1306): n is a, c, g, or t
  misc_feature (1312)..(1312): n is a, c, g, or t
  misc_feature (1353)..(1353): n is a, c, g, or t
  misc_feature (1378)..(1378): n is a, c, g, or t
  misc_feature (1405)..(1406): n is a, c, g, or t
  misc_feature (1441)..(1441): n is a, c, g, or t
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgttggggggggggtttgcaagaatatttaatttaattttttggatgaaattttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaaaacaaaaaanaannnnaanaaacancgaancngaagngacctatgaagcctacactatagcatcatattttttatcaaaacaagcngnntgncanngggccggaaagnncnggagnaatcccacaactccaaaagctccaccacgtccgctaaactacttaagnaacttnaatctacaaatctaacaagtctgaaagggagactggttctntaagaactccaacatccacagtcgnaagaccacacgccagttaaaagagcanngtcacgatgaaggggactcgataaagaaaatcgantgacgaggatgcaatccgcagcttcagcccc

SEQ ID NO: 381748 - DNA, 973 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggttggagaaatttatttacttttggtggaattatcgtttttttaacgttttgggtgtgcgaaactaagattgggggtggggcggaatcccatgggag

SEQ ID NO: 381749 - DNA, 1430 bp, Homo sapiens
ctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctgcctgcctctgcctgcctgcctgcctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381750 - DNA, 2378 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaatgaatgactttgttctaccctgtgtttctagaagctagagggggaaaaaaaaagccctttggatatgaatatcatgtcctagcttctgcggctctctcttcactgtggtttgtggttactgcctattagatggtatgagggaggcattcctgcatcggtccacctgctcagggtccacacccaggacacttgaggcccccaggccagcttatcagtgagtgaagtggaaaaatgaagccagaggatgcttgtgaagttgaaaggatgctcttagatcagacagttctaggaagggatcttaggggcctctgcatcagctttattgtgcaacagtaaggaaacagggccagagagaaaggccttactcaaggtcacatccaggcagtggcaaagtaggaccagagcccctgtttgttgattttcccctcttccaccctcatttcttaggaactaaactcagtatcctagtagcacgtaacttttcatgtaagtgttagaatcattaagtacatgaatgctactggcttccttccaactggccccagacctttttatttgctcccctcctgccataggaaccagagggtcacagccaaggcctgggtgaggacacttttgtttgaaagccacaacaaatggctgccatcctatttgtgatggcagtcagagctacttgtaacctggtcctgttgtgcacatctatctgccatggagggatctggtgcctccagacatgtgcacatgaatccatatggagcttttcctgatgttccactccactttgtatagacatctgccctgactgtgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381751 - DNA, 1943 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaatgaatgactttgttctaccctgtgtttctagaagctagagggggaaaaaaaaagccctttggatatgaatatcatgtcctagcttctgcggctctctcttcactgtggtttgtggttactgcctattagatggtatgagggaggcattcctgcatcggtccacctgctcagggtccacacccaggacacttgaggcccccaggccagcttatcagtgagtgaagtggaaaaatgaagccagaggatgcttgtgaagttgaaaggatgctcttagatcagacagttctaggaagggatcttaggggcctctgcatcagctttattgtgcaacagtaaggaaacagggccagagagaaaggccttactcaaggtcacatccaggcagtggcaaagtaggaccagagcccctgtttgttgattttcccctcttccaccctcatttcttaggaactaaactcagtatcctagtagcacgtaacttttcatgtaagtgttagaatcattaagtacatgaatgctactggcttccttccaactggccccagacctttttatttgctcccctcctgccataggaaccagagggtcacagccaaggcctgggtgaggacacttttgtttgaaagccacaacaaatggctgccatcctatttgtgatggcagtcagagctacttgtaacctggtcctgttgtgcacatctgtaagtggaggggctttttaaactctctgtttgaaccacacacaccttggtaatacaggcctggttaagtttgataactggtttcttcacctgtcattgctactgggagggaatccctggcactttacagggcctttgtctgcccagaggtctgcacctaggccaaaatccctttcctgttctttgagagctgagtcattttttgaacataactgtactcgagggagccttggaattattttcctggttgggaacaggctttctgtaaacttgatgaggtagagggaggataataattcattatggctaactattctcttcatttatattctttctattgtactactataattgtttatta

SEQ ID NO: 381752 - DNA, 826 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaa

SEQ ID NO: 381753 - DNA, 793 bp, Homo sapiens
gcggccgcctactactactactactgctcgaattcaagcttctaacgatgtacggggacatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaacaatgaaaacagcagagaaacacacacgaaaagcaaaacaaacacaaaaacaacgagaaaccgaggggcacccaaggcccacagcaaaaaaggccacaacacgcgagacacacaagcaaagacccagggagaaggagacaaacagcgcggacaaggagcccagcgcgacgcaaaaatgcggactaccgggcagaaggagagaggaacacggcgacggaagaacgcaagcaacaacagagaacagaagggcgaaccacagcgggacgaccaagcatacaccaggggaacaacaccaccataaacgcacaggacagaaacgtggcaacaagaaagcaccaacacccgccagcccgctcccgccagacaggtagcagagccacaccaaacccaacggagaacaaagaacaagaaagaagaggcgcaaaacacacgacccaacacgacaaaagcaaacac

SEQ ID NO: 381754 - DNA, 1270 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttatccaaaaaaaaaaaaaaaaaaaaaaaaaacttgggggggggcccgggccccggaacacgcgtttacaagcccactgcgggggggcgcgcgcggggcccacaagagcacaagctgcacacttggcgcacacaaggcggagcccacagaggagaaccccgggggccagagaacaacgcgggcggggagatctctcacaccaatattaaaacacggccccggggcgacacacccgcgggcttctctggaaacaaacatcccaaagggggcatccacgagggcagccacaaaggggggacctcactcaccacacaggggggaggtcccaaaggcgggacagccgcagcggagaaattcccacaaataagacccccccgcggctgtgggcgcaggtggaggagaaaatagcgacgagccgcacgcgagcagaagacacgaacgccggcaactaacagggagagagtatgagacgatcacacaacacgagcgtacggacgaacagagacacaagacgccgagaagaatagcagaactcaa

SEQ ID NO: 381755 - DNA, 2103 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaacaatgaaaacagcagagaaacacacacgaaaagcaaaacaaacacaaaaacaacgagaaaccgaggggcacccaaggcccacagcaaaaaaggccacaacacgcgagacacacaagcaaagacccagggagaaggagacaaacagcgcggacaaggagcccagcgcgacgcaaaaatgcggactaccgggcagaaggagagaggaacacggcgacggaagaacgcaagcaacaacagagaacagaagggcgaaccacagcgggacgaccaagcatacaccaggggaacaacaccaccataaacgcacaggacagaaacgtggcaacaagaaagcaccaacacccgccagcccgctcccgccagacaggtagcagagccacaccaaacccaacggagaacaaagaacaagaaagaagaggcgcaaaacacacgacccaacacgacaaaagcaaacac

SEQ ID NO: 381756 - DNA, 1886 bp, Homo sapiens
  misc_feature (137)..(137): n is a, c, g, or t
  misc_feature (140)..(140): n is a, c, g, or t
gaacttggacttagaacttcaataataggggcgcacatctgggcgatgtcaaccggcgagtggcgtactcttactacatatacgagttagtaaggcatggcgatcatctcgaacggtgcgcagcgacgcgatctagnagncgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381757 - DNA, 1834 bp, Homo sapiens
  misc_feature (880)..(880): n is a, c, g, or t
  misc_feature (883)..(883): n is a, c, g, or t
  misc_feature (891)..(891): n is a, c, g, or t
  misc_feature (900)..(900): n is a, c, g, or t
  misc_feature (903)..(905): n is a, c, g, or t
  misc_feature (912)..(912): n is a, c, g, or t
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtaggggggggggtntgnaagaatanttatttaanttnnnggatganatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381758 - DNA, 1966 bp, Homo sapiens
  misc_feature (137)..(137): n is a, c, g, or t
  misc_feature (140)..(140): n is a, c, g, or t
gaacttggacttagaacttcaataataggggcgcacatctgggcgatgtcaaccggcgagtggcgtactcttactacatatacgagttagtaaggcatggcgatcatctcgaacggtgcgcagcgacgcgatctagnagncgtggaaccgccgccaggtcgctgttggtccacgccgcccgtcgcgccgcccgcccgctcagcgtccgccgccgccatgggagtgcaggtggaaaccatctccccaggagacggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381759 - DNA, 1664 bp, Homo sapiens
  misc_feature (1630)..(1630): n is a, c, g, or t
  misc_feature (1633)..(1633): n is a, c, g, or t
  misc_feature (1635)..(1635): n is a, c, g, or t
  misc_feature (1637)..(1637): n is a, c, g, or t
  misc_feature (1641)..(1641): n is a, c, g, or t
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttttgagaaaagccggcataaagcacttttattgcaataataaaacttgagactcataaatggngcngngngaanggtgcagcaacgatttctcacca

SEQ ID NO: 381760 - DNA, 1773 bp, Homo sapiens
  misc_feature (137)..(137): n is a, c, g, or t
  misc_feature (140)..(140): n is a, c, g, or t
gaacttggacttagaacttcaataataggggcgcacatctgggcgatgtcaaccggcgagtggcgtactcttactacatatacgagttagtaaggcatggcgatcatctcgaacggtgcgcagcgacgcgatctagnagncgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381761 - DNA, 1773 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381762 - DNA, 1723 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgtggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381763 - DNA, 1475 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaaaaaaaaaaaaaaaaaaaaaaagaaaaaaaaaaaagaagaaaaaaaaagaaaaaaaaaaaagaaaaaaaaaaaaaaagtcgggaggacaacaagaaatccatccaacgcaagagaacagagacggcactgcgagcacaccatagctacccgcggcgtaccactctagcgcgtctcacagacgaggcgag

SEQ ID NO: 381764 - DNA, 3405 bp, Homo sapiens
cgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcaccatttatgagtctcaagttttattattgcaataaaagtgctttatgccggcttttctcaaaaaaaaaaaaaaaaaaaaaaactcgagactagttctccgctgctccagcctctggggcgcattccaaccttccagcctgcgacctgcggagaaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattg

SEQ ID NO: 381765 - DNA, 860 bp, Homo sapiens
agtttgtataaaaaagtaggttggtattggtttggaatttttgggatattgtcgatctatgtgtctggacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaaaaaaaaaacaatgaaaacagcagagaaacacacacgaaaagcaaaacaaacacaaaaacaacgagaaaccgaggggcacccaaggcccacagcaaaaaaggccacaacacgcgagacacacaagcaaagacccagggagaaggagacaaacagcgcggacaaggagcccagcgcgacgcaaaaatgcggactaccgggcagaaggagagaggaacacggcgacggaagaacgcaagcaacaacagagaacagaagggcgaaccacagcgggacgaccaagcatacaccaggggaacaacaccaccataaacgcacaggacagaaacgtggcaacaagaaagcaccaacacccgccagcccgctcccgccagacaggtagcagagccacaccaaacccaacggagaacaaagaacaagaaagaagaggcgcaaaacacacgacccaacacgacaaaagcaaacac

SEQ ID NO: 381766 - DNA, 957 bp, Homo sapiens
  misc_feature (137)..(137): n is a, c, g, or t
  misc_feature (140)..(140): n is a, c, g, or t
gaacttggacttagaacttcaataataggggcgcacatctgggcgatgtcaaccggcgagtggcgtactcttactacatatacgagttagtaaggcatggcgatcatctcgaacggtgcgcagcgacgcgatctagnagncgtggaaccgccgccaggtcgctgttggtccacgccgcccgtcgcgccgcccgcccgctcagcgtccgccgccgccatgggagtgcaggtggaaaccatctccccaggagacggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaa

SEQ ID NO: 381767 - DNA, 551 bp, Homo sapiens
ctggtcctggcttttgagaaaagagccagcagcctctggtcttgttgacaccatcatctgagagtggcaggccaccagagggaagggctaaggacagagccagatctggctgggccatctcaccttctggaggccgaacttgacccgggatggaaataatgaagcagccactggctttcccaaggcctgtgatcctcctggtcaccagaaatcccaagttcttatctcctgctcttccagtctcctctgttagggtactggttcccagcgcagagcttctgtgattaccagaagaacactgaaggagtcttcttgtctgtctggagccagctgagatggccctgagatccacagagcctcctccacgcccctggatggaggcgctcctgctcttccaccctttgtatctctcacttggcacccattcccgtaattaatcacaaactccgtctgagctattcctttctaagccatgccctctgtactctgacttgccccaaatagacagatgctcaataaatatttgctgattggctggaaaaacaaacaga

SEQ ID NO: 381768 - DNA, 417 bp, Homo sapiens
tcatactctataaaaataccaataataaaaatcctgtaaggaaaactaggaaactatagtcttatgtgggggagacttttcagcattagaaaactggaagctataaaagaagagatagctgtttgccttttcagatgctgaaactttgtaaatggtaaaagacatttaagtcaattgaagaacaccagattatgagaaaatatgcagtgcagaggaaaaataacatttaattgtgaatttcatatttaggaactcataaataaaaattagccaggccttgtggcacatgcctttagtcccaaccactcaggaggctgaggtaggaggattgcttgagcctgggaggttgaggcttcagtgagccgtgattgtgtcactacgctgcagtcttggtgacagagcaggactttgtttcca

SEQ ID NO: 381769 - DNA, 1420 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacggtaggtgcatgcgcaccgcaagagacagcctggatctgtgcagggacggggcaagggaagtggaagaggccgcccgagcgtgccacgtgagcgtgagcatgcgcgctgtggctagtttggagcgctagagagaaaaactttattgatagcttcagtgttcgtggttggttttgttccttgggaggttttgtttgttttttgagacaggctccgtctgtcacccaggctggagtgcagtggcttgatttcggctcaccgcaacctctgcctcccgggctcgagcgattctcctacctcagcctcccaaggggctgggattacaggcgcccgccaccacgcccgactaatttttgtgtttttagtagaggtggggtttcaccatgttggcccaaagtgctgggactacaggcctgagccatcgtgcccagcccttctcgttttttaaataaattaccacaggtcaagcaggtaaaacaatgcctggcacacagtttagtgctcacttaagtgttagtggtggtggtggtggtgttagtattttattctgtttttctgcaaatctttactgaactgctcattatgcaccaaggactctgctacattctaggaattcaaaaatgaacgagagagttccagtcctcagatagctcataatcaagctgtgtaatagtcaccggataataaaatgtaatgagatgcattgactaaagtatggagaggattctccggtggagcattaaagggaatagtgtctgatgctcttttttttgcagactttatcttttcatttatcatctatttcatagttctaatgcaaagcactgtattgccccctt

SEQ ID NO: 381770 - DNA, 287 bp, Homo sapiens
tgaaggaggagcagaagagcaacacggcagggagccagtctcagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgagga

SEQ ID NO: 381771 - DNA, 2871 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381772 - DNA, 2941 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtgggtgagtcccagaaaagccagtggcccgagtgcccaggagacccacagcatgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381773 - DNA, 2817 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaagggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381774 - DNA, 2561 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381775 - DNA, 2455 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggcgtctttggatcacactgcgcggctgctggctccatcacaaaacaatgaaggaggaagtgggacgcagagagaaacgcacatggggagaacgccacgtgaaggctgaggtcgggataatgcatctgcaagccaaggaacacctaagaggaccagcaaaccaccagaagccaggggagaggcgtggaacagaccctgccttacagctgtcagaaggaaccaaccctgccaacaccttcctgttgtactttcagcttccagaactaaaaaagagaaaaaagcagggtaagaagagaaagtggtggagctgagctgggcagagtggctcttttagaagcgatgacatttacacataggtcactatggagagggccatgcagacacctggaggagtgccacagacacagggaagagtgcaggctttctcctctgggcctgtcagatctactgaagacaggaatgaagttgttttccagaattctcctgtccagcaagggccgcaggcagcccgtgctgccaggagagcacacctccctactgccatcccaaagaggtggatcttcca

SEQ ID NO: 381776 - DNA, 1485 bp, Homo sapiens
tttttttttacaaagaaggtataactttaataaccctatttacagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgagatgggtgtcgtgagctggtggtgggctacacagaccgtgtggtgcgagctttccgctgggaggagctaggtgagggtcctgaacatctgacagggcagctggtgtccctcaagaaatggatgctggaggctcccatgataagccaggcatcactcaaggcactggaattgccatagtgaataaatagacaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaactgaggcaggagaatcgcttgaacccgggagacggatgttgcagtgacccaggatcatgccactgcactctagcctaggcaacagactccgtctcc

SEQ ID NO: 381777 - DNA, 1570 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgtgggcatgcctacctttgcaggcagccaggagagtaggagtcagtggatactagagcatatcccaagggattggggtgagagggagaatccgtattcatgtatgcatttgttatgtgctgagctcccatgataagccaggcatcactcaaggcactggaattgccatagtgaataaatagacaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaactgaggcaggagaatcgcttgaacccgggagacggatgttgcagtgacccaggatcatgccactgcactctagcctaggcaacagactccgtctcc

SEQ ID NO: 381778 - DNA, 291 bp, Homo sapiens
ccttcccctgctgctgcagaacacccctctccccgtaggctctgaccttgccctgccctttacatattcttcctctggtcctcacaggccacggcactgagagtagtggctctggcctctttgccctgtgcaccctggatggtgagcaatgctaggatggggtgtgggggctgtatgcctgtagggtctgctcggggcctatcccacccacactcagcctgcctctcccccggcagggacactgaagctcatggaagaaatggaagaagcagacaagctgctgtggtcagt

SEQ ID NO: 381779 - DNA, 749 bp, Homo sapiens
acaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaaaatacaaaaagtagccaggcatggtggcaggcacctgttatcccagctactcaggagactgaggcaggagaatcgcttgaacccgggagacggatgttgcagtgacccaggatcatgccactgcactctagcctaggcaacagactccgtctccaaaaaaaaaaagaaaataagtgcagccgaccacggtggttcacgcctgtaatcccagcacttcgagagcactttgagaggctaaggcaggcggatcccttaagctcaggtgttcgagaccagcctgaccaacatagtgaaaccccgtctccagtaaaaatacaaaaattgggctgggcacggtggctcacgcctg

SEQ ID NO: 381780 - DNA, 395 bp, Homo sapiens
cctgaatcagcaggtaggggctatactttatattgccatcaggcatgcttgttggtttaggagaagaggcagacctgggtttgaatcctgattctgctgcctcctagctgagtggccttgggtgagtgactctatttctatgagctgaggtttcctcagtataaaattgcctacttcctagggtggctgtgagcattatgtgaggtggctcatttgacagttgcgtttactgccgaacccacgggtgaaattcctccccagctcgctgtttgtcatccagaatccagtccacagctcctttatgttccttttgtctctgtcctttttcagggcaacgggcatgaggaggtagttgcatgcgcctgggatggacagacatatatcattgatcacaa

SEQ ID NO: 381781 - DNA, 565 bp, Homo sapiens
tcctgcctctgaagggcccacggatggtagtaggtaagggggtacaggccagtggatggtgtgggggtgcatggaagcaggatgggctcccagatgccacatggtagtaaaatgggtctgcagttggcagagctgcctcatctaggtcccaacccaagcacctttgccccactggggaagattactttaagaccaagggaatcctgggctctaactttgtagcacctgaaagaggtcctgagattccaacctggcagccccatccctgtcttttctgtttgccacatgggccagatagggtcagtggtaggtttctaagctgattcaaatcccagaagctcttgcagggataggggttacaaagggctggagagctcagctcacttggtctcccgcttgatccgtccacctgctgtgcacagggagaccccagctgcccgagacgtggtgctgcaccagacatctggccgtatccacaacaagaatgtctccactcacctaattggcaacatcaaacaaggtgaaagtgtggtgggtgtgagggagggagatgaggggtagccgt

SEQ ID NO: 381782 - DNA, 1183 bp, Homo sapiens
acggtctgcagccctgtggagaaaaggagtggcccgtgggcctgtcactcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacggtaggtgcatgcgcaccgcaagagacagcctggatctgtgcagggacggggcaagggaagtggaagaggccgcccgagcgtgccacgtgagcgtgagcatgcgcgctgtggctagtttggagcgctagagagaaaaactttattgatagcttcagtgttcgtggttggttttgttccttgggaggttttgtttgttttttgagacaggctccgtctgtcacccaggctggagtgcagtggcttgatttcggctcaccgcaacctctgcctcccgggctcgagcgattctcctacctcagcctcccaaggggctgggattacaggcgcccgccaccacgcccgactaatttttgtgtttttagtagaggtggggtttcaccatgttggcccaaagtgctgggactacaggcctgagccatcgtgcccagcccttctcgttttttaaataaattaccacaggtcaagcaggtaaaacaatgcctggcacacagtttagtgctcacttaagtgttagtggtggtggtggtggtgttagtattttattctgtttttctgcaaatctttactgaactgctcattatgcaccaaggactctgctacattctaggaattcaaaaatgaacgagagagttccagtcctcagatagctcataatcaagctgtgtaatagtcaccggataataaaatgtaatgagatgcattgactaaagtatggagaggattctccggtggagcattaaagggaatagtgtctgatgctcttttttttgcagactttatcttttcatttatcatctatttcatagttctaatgcaaagcactgtattgccccctt

SEQ ID NO: 381783 - DNA, 2970 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaattggaaaactaaatttcccccgggcgtggccccttccttggggttgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtgggtgagtcccagaaaagccagtggcccgagtgcccaggagacccacagcatgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381784 - DNA, 2946 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgtgggcatgcctacctttgcaggcagccaggagagtaggagtcagtggatactagagcatatcccaagggattgggatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381785 - DNA, 2181 bp, Homo sapiens
gcggataggagctgcggaacagatggaccaaatggacgggcaagatgccgcaaacacaggcaggggcgggggcagactgagggtgaagtgagtagcaccgcagatcgggtgtgaagccgcactggctggaaggtgccactgttagcagaggagcgggggctgctcgtgggactccagagcccatcttgtctttcatgcccacagatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381786 - DNA, 1600 bp, Homo sapiens
acaggccactgtcacctgccagcaggccagacagtccccagggtgatggacaaatcctgaagacatcagtgggtcttccctgtctcgatggctggcacgtccaggagtccaggagaaacaggtctttccatgcccaagttggtacctttttgggtgagaacactctgtatgtaccatttgtagaatcttggcacacatctgctgggtatcttcttcattcatacagcggaaacttgaactcagatctctcagccttttgtctcctttttcaaaccaagtcttgctgcacatcagagttgggaagcccgcctccaagcccggaagacccgcctcctctgtaaggttaaaggaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtca

SEQ ID NO: 381787 - DNA, 962 bp, Homo sapiens
ggaggggcagctataaaggccgcgccggggccacgaggagcagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctaccatccggctgtggctcagtgagactcctgctgggagggtggaggcccaggaatgggcgggcaggacaccctcatccagtcctgcggggctggtgtgaaaggcgctgggaaccggctttgaatgaataaatgaatcgtgtcatctgca

SEQ ID NO: 381788 - DNA, 816 bp, Homo sapiens
ggaggggcagctataaaggccgcgccggggccacgaggagcagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctacc

SEQ ID NO: 381789 - DNA, 935 bp, Homo sapiens
tcagctggacaaggcagggtcagctggacaagggagggtcatttgacgtcaggagttcgtgatcagcctggccaacatggtgaaaccctacctctacttaaaatacaaaaattggctgggtggtagtggctcatgcctgtagtcccagctactcgggaggctgaggcgggagaatcgcttgagcctgggaggcagaggttgcagtgagccgagatcgtgccactgcactccagcctgggcgacagagtgagaccctgtctcaaaaaaaacccacaaaaataataaaaaggatgttaaatataatctggctcagttttctgccagttcctgagtctcttcaatgttcccactatctggcctttccaggccctgcctaaatgaggtatacacccctgacctgtgcagcttattctttatgggcagtgctcattattaaaacattcttcctgaacgtgagatccactctgtcctccgacagccctgcccactagagaggccacacaggctggttgccctcccaagttagcctgtcataccaccccttggtcttccctaggctgagcacccccgttttcttcagctgtttctcataacatgatctcaagcctcttctgaaccccaggctttcttgagtctccatatgagcatttgcctctgtgggcacaacttcaagtgtcctttgtgaggaaatgtgcatctctggttggtgaacttccatccctcagagagaaatagaagcacaaatttgaaacaagctgtctgtctgtctgtttctttatgtcttggaaactttatttatccatccaagctttttttttttttttagcctttgagagcaggcaaccatccaagctcattccacgaacccagagaattaaatatacctgatttgtagcacaaaataaataaatgataaaagttccctcaaaccttcc

SEQ ID NO: 381790 - DNA, 20437 bp, Homo sapiens
  misc_feature (6)..(6): n is a, c, g, or t
  misc_feature (12)..(12): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (26)..(26): n is a, c, g, or t
  misc_feature (68)..(68): n is a, c, g, or t
  misc_feature (221)..(221): n is a, c, g, or t
  misc_feature (352)..(352): n is a, c, g, or t
  misc_feature (1120)..(1120): n is a, c, g, or t
  misc_feature (3066)..(3066): n is a, c, g, or t
  misc_feature (3101)..(3101): n is a, c, g, or t
  misc_feature (3169)..(3169): n is a, c, g, or t
  misc_feature (3211)..(3211): n is a, c, g, or t
  misc_feature (3655)..(3655): n is a, c, g, or t
  misc_feature (4593)..(4593): n is a, c, g, or t
  misc_feature (5613)..(5613): n is a, c, g, or t
  misc_feature (6054)..(6054): n is a, c, g, or t
  misc_feature (6075)..(6075): n is a, c, g, or t
  misc_feature (6148)..(6149): n is a, c, g, or t
  misc_feature (13416)..(13416): n is a, c, g, or t
  misc_feature (13535)..(13535): n is a, c, g, or t
  misc_feature (13613)..(13613): n is a, c, g, or t
  misc_feature (13669)..(13669): n is a, c, g, or t
  misc_feature (14943)..(14943): n is a, c, g, or t
tgcctnccagcngcccncanccngcngctgcccagagcccccatagagagaggtccccgccgccaccntcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtgncggccggcgcgcgcttccgtctggcccaggacggcgacctctaccgcctcactatcctggacctggcgctgggcgacagtgggcaatacgtgtgccgcgcgcgcaatgccataggcgaggccttcgctgcngtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggcnacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactgaccatctcccagtgctgcctggaggatgtgggccaggtggcctttatggctggcgactgccagacgtccacccggttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccantgccacgctgagctgcgaggtggcccaggcccagncggaggtgatgtggtacaaagatgggaagaagctgagctccagcttgaaagtgcatgtagaggccaanggctgcagacggaggctggtggtgcagcaggcaggcaagacngatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacngaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcgcacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcangcttcacctgcacgctcagcgaggcggtgcccgtgggagaggcgtcctggtacatcaatggcgcggcagtgcagccggatgacagcgactggactgtcaccgccgacggcagtcaccangccctactgctgcgcagcgcccagccccaccacgccggggaggtcaccttcgcttgccgcgacgccgtggcctctgcncggctcaccgtgctgggcctccctgatcccccagaggatgctgaggtggtggctcncagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcnctggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 381791 - DNA, 2882 bp, Homo sapiens
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcaggtcagtgctttggggatgctgagtgagccctgtttgtagctgctgctgtgactggagtagaaccactgctgacccagtgggctttccattagactccatccctcaacttctcccatcctctcacctcctatttttatgcctgtggtggagctgggctgcttagtggggaagggagtgaacggaagggtcagggccctccttgtccatgttgggtggtgtttctgtgcagacatgctgggtcacattttcccagtaccttctccaaactaccgatgtcccgaggtgtccaggactctggtcctatctaatgcatgagatggcggtaagccagacgtccctccctcggggatactcctgcagtccctgcacggcctcatctggccccatgtgagggctctccctgtggaaagagattttaattcgttgagtcagggtgtagggaaattccagccacacagtcttatttggaattatatcaacactgaacactgggttcccaaagttttcagtgttctgggacacacttctgtccttccctgtggatgtagaagccctgtcagagccctgactaaaacccagatccacagcgttagtgtgtgcaaaacgagtaaagagcagcacattggcaggtgcgcacacgtgacgttggaattccatttcggaagccaatctcactttccttttgcattctgttagaatgttctgtgtctgaattccccttggaatttggatagatttaaaagtgataggaataagtagctggtgtttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggtgggtttttaggtcccttccagtgccacactgtggggtgttgaggggccgcgcgaggcaggcccttccatgaggcctggactggaggccttctctaggcgccggcgctggcctgggccgcctgccgccacacaggggccgcacgcctgggccccagggcccctttgccggcgggaggccggggggaccgactgctcttggcgcccggggtcaggggaggccgggaaacctcggctcccgggcgacaggcacccaggcccttctcagccccccggccgcggccgcgccgggcctcgcttcagccgggcgattcttcccctcatttgttgcattgtttgcattaatatgaatatcttgttctgtttgttttgtctcctgagagccaataaagctgtgttttttctttacaccaaaaaaaaaaaaaaaaaaaaaaaggaataagtagcttatggcacagtgacacactggtagaattaagttatggtggtagcagtcgctgactggggaagccatatttacatcatcctgtttccttgatgagtcctgtgcctgccccctctccagctgattcataggaagtctgagaatgacctttactttcctattgtttgttaggagagtttaacttcaaactccaaccctgagccctgagtgccaccacataacagttggtgttatatatatctaaaatggtttacaaatgtgtagataccaaaaatactcactgcaagtaaatttgaaaagtgttaacaaattatataatttctagaaaccaaaaacagacttaagaaatagataacctata

SEQ ID NO: 381792 - DNA, 8991 bp, Homo sapiens
  misc_feature (1577)..(1577): n is a, c, g, or t
  misc_feature (2018)..(2018): n is a, c, g, or t
  misc_feature (2039)..(2039): n is a, c, g, or t
  misc_feature (2112)..(2113): n is a, c, g, or t
  misc_feature (8909)..(8909): n is a, c, g, or t
  misc_feature (8920)..(8920): n is a, c, g, or t
  misc_feature (8927)..(8927): n is a, c, g, or t
  misc_feature (8929)..(8929): n is a, c, g, or t
  misc_feature (8935)..(8935): n is a, c, g, or t
  misc_feature (8943)..(8943): n is a, c, g, or t
  misc_feature (8945)..(8945): n is a, c, g, or t
  misc_feature (8950)..(8950): n is a, c, g, or t
  misc_feature (8956)..(8956): n is a, c, g, or t
  misc_feature (8961)..(8961): n is a, c, g, or t
  misc_feature (8972)..(8973): n is a, c, g, or t
  misc_feature (8975)..(8976): n is a, c, g, or t
  misc_feature (8978)..(8978): n is a, c, g, or t
  misc_feature (8982)..(8982): n is a, c, g, or t
  misc_feature (8989)..(8989): n is a, c, g, or t
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggagaatngcttgaacccnggaggcngnggttgnagtgagcnangatcntgccantgcantccagcctggnnannanagcnagctctntc

SEQ ID NO: 381793 - DNA, 6263 bp, Homo sapiens
  misc_feature (6181)..(6181): n is a, c, g, or t
  misc_feature (6192)..(6192): n is a, c, g, or t
  misc_feature (6199)..(6199): n is a, c, g, or t
  misc_feature (6201)..(6201): n is a, c, g, or t
  misc_feature (6207)..(6207): n is a, c, g, or t
  misc_feature (6215)..(6215): n is a, c, g, or t
  misc_feature (6217)..(6217): n is a, c, g, or t
  misc_feature (6222)..(6222): n is a, c, g, or t
  misc_feature (6228)..(6228): n is a, c, g, or t
  misc_feature (6233)..(6233): n is a, c, g, or t
  misc_feature (6244)..(6245): n is a, c, g, or t
  misc_feature (6247)..(6248): n is a, c, g, or t
  misc_feature (6250)..(6250): n is a, c, g, or t
  misc_feature (6254)..(6254): n is a, c, g, or t
  misc_feature (6261)..(6261): n is a, c, g, or t
cgctaggtagagggctgggttgatggacgaggctgacaacgtgcgcttgcgcaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggagaatngcttgaacccnggaggcngnggttgnagtgagcnangatcntgccantgcantccagcctggnnannanagcnagctctntc

SEQ ID NO: 381794 - DNA, 7793 bp, Homo sapiens
  misc_feature (1577)..(1577): n is a, c, g, or t
  misc_feature (2018)..(2018): n is a, c, g, or t
  misc_feature (2039)..(2039): n is a, c, g, or t
  misc_feature (2112)..(2113): n is a, c, g, or t
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcaggggtaaagaccacatgtggccacctgagtgattcctgtctcctcccacctaacccacatgatctgtgctctcccagttcctcttgatgtcattgccatctcatt

SEQ ID NO: 381795 - DNA, 8090 bp, Homo sapiens
  misc_feature (1577)..(1577): n is a, c, g, or t
  misc_feature (2018)..(2018): n is a, c, g, or t
  misc_feature (2039)..(2039): n is a, c, g, or t
  misc_feature (2112)..(2113): n is a, c, g, or t
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcaggggtaaagtccatctgtccagatctgcgttctggtgtccagttgttcacttcttgccatcaatctctgctcattgcatggtctcccccagactgccacactcttcacgtcatgccacactatcccttccagcttcct

SEQ ID NO: 381796 - DNA, 2935 bp, Homo sapiens
  misc_feature (1577)..(1577): n is a, c, g, or t
  misc_feature (2018)..(2018): n is a, c, g, or t
  misc_feature (2039)..(2039): n is a, c, g, or t
  misc_feature (2112)..(2113): n is a, c, g, or t
ttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaacggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttctcgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtacactgcggcccactgacaacgtgcgc

SEQ ID NO: 381797 - DNA, 360 bp, Homo sapiens
atgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcaggggtaaagatcctgtgtggtcacatggacttgtggcttggaatctaagtgtctctgtgtcaccaccttctacttccaaatgtggcacccctgtgggaaccctgaggttgtgtgtcctctaac

SEQ ID NO: 381798 - DNA, 403 bp, Homo sapiens
caggccttctctccccagtgctgccttcctgaccttgatggtggtggtcaccctatgcatccctgccttccccagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcaggtcagtgctttggaggtcctgaggagcctcttcagaggtgatggtgcttctg

SEQ ID NO: 381799 - DNA, 2270 bp, Homo sapiens
gccatgttctgtccgaaaaatcctccagacagtctgatgatatcagtgactgtttggtccttctcagccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcaggggtaaagaccacatgtgaccacctgagtgacttctgtcttcccccacttaacccacatgttctgtgctctcccagtgtctctcagtgtcgttgacattttattcagtcactcatctttgtggtccatctcacaaatgcatgctgaggacccacttggatggcctaatctagggcctgggcatacagaccccaagggtgaatagtgcagggtccccaggtgtcaggacagggagagcagcaggcaggtgtcagggtccaggagagctgtctggggcccctgccatcttgcaaaggcctgtggatgtccaccagctcttgagcctcaggcatggaggtcaggaaatgtatgtcctttgacagacatagcgatggctcaggccaggcccctcttcaggctggtgagtgttctgattgatccttgtggtcattccaagcttctaaaggagtattgtcttcatctgctcaggctaacgtaacaaagcactgcagacagggtggctcaaataacacagatttattttctcagaagtatggggctgaaatctcaagatcaagatgtcagctcctctcttcttgtagacagctgtcttctccccatgtcttcacatggatgtccctctgtgtgcatgtgtgtgtcctaacctctttttataagagcaccagtcatactggatttggaaccaccctaacaacctcatttttcctttcaatgattgtctttaaatacagtgatattctgacgtgtactgggggttaggacttcaacatatgcattttttctgaggcacaattcagaccataacactccaccatctggattctcaaaattcatggccttctcacgtgcaaaatatgtttacttcttcctaacagtcccaaatcttagcccatttcaatatcaactagtccaaatcacctctaaatatcatctgagtcaactgtgagggagataaagtgtgacttatacagaggcaaaatttttcttcatctgtgaggctgtgaaatcagacaagttatttgttttgaagtcacaatggtgggacaggcataggatggacattctgaatcagggagaaactggaaaggaggaatgagtcacgggtcccaagtaaggtgtaaccctagcaggacaaatattattaggttttaaggctttggattaatacctagtcctctcgacccaacagggttgcaactctaccccctcagccctgagtggaggtgtctggctctctgtaactgaggaggagacagccttacttccaggcctgtgccctctaccctctggttataatgccattcctgtcaactcctgaactaacttttgggtcattattcctttttcttacagaatatcttgtttatatccatgtagctctattggcccatcctgtggattctcagaagtctgacatccttccttcattttgtcccatctctgttcgaatcagttcaagctagcagcatttcctctggtataaaggtctcaaaaactttgtcccatgtgatccatgtgggtcaaagccaccagacaaaagaattctccacagatctttccttgataatcttatttttattactggcttctgctgagagggctgaatggatccataaaccacacacctgatctgtttagcaaatggttgtccagtgtggatattctccccagaataatgctttctcatttttttttgcagtatgtatagcctgaaaatttttctgtatcttcaagctctggttcctttttgcttaacaaatcctttttgaatttatctctctcctctcacattttcatattagagagaaatcaggctatggtttcaattctttggttagaaacttcctcaggtaaatatatccaattttgttgtttgcaagtcctatcttccacaaaacactagaataaaatttgaccaggtttttggctactttataacagt

SEQ ID NO: 381800 - DNA, 9401 bp, Homo sapiens
  misc_feature (967)..(967): n is a, c, g, or t
  misc_feature (1987)..(1987): n is a, c, g, or t
  misc_feature (2428)..(2428): n is a, c, g, or t
  misc_feature (2449)..(2449): n is a, c, g, or t
  misc_feature (2522)..(2523): n is a, c, g, or t
  misc_feature (9319)..(9319): n is a, c, g, or t
  misc_feature (9330)..(9330): n is a, c, g, or t
  misc_feature (9337)..(9337): n is a, c, g, or t
  misc_feature (9339)..(9339): n is a, c, g, or t
  misc_feature (9345)..(9345): n is a, c, g, or t
  misc_feature (9353)..(9353): n is a, c, g, or t
  misc_feature (9355)..(9355): n is a, c, g, or t
  misc_feature (9360)..(9360): n is a, c, g, or t
  misc_feature (9366)..(9366): n is a, c, g, or t
  misc_feature (9371)..(9371): n is a, c, g, or t
  misc_feature (9382)..(9383): n is a, c, g, or t
  misc_feature (9385)..(9386): n is a, c, g, or t
  misc_feature (9388)..(9388): n is a, c, g, or t
  misc_feature (9392)..(9392): n is a, c, g, or t
  misc_feature (9399)..(9399): n is a, c, g, or t
tatactcctatggcagtggtcttgggttggaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggncgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcntcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagagcgcctgtgctgttcaaaaagaagctgganccgcagacggtggaggagcgnagctcggtgaccctggaggtggagctgacgcggccgtggccggagctgaggtggacacggaacgcgacggccnnggcgccgggaaagaacgtggagatccacgccgagggcgcccgccaccgcctggttctcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggagaatngcttgaacccnggaggcngnggttgnagtgagcnangatcntgccantgcantccagcctggnnannanagcnagctctntc

SEQ ID NO: 381801 - DNA, 1859 bp, Homo sapiens
accttgtgctttgtttctttagttctgtggcagggggtgggggactctgtaggttgggctcacatgcatgtgtaagagttctttgtgcactctcactgctggcttgctggtacaataacctgagctctcacgctgccctggcaatcctgggcgctgtgcccatcttttctcgggccctctcctccctcccccagagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaactgatt

SEQ ID NO: 381802 - DNA, 459 bp, Homo sapiens
gttcccggggactgtccacctgggtaagtgggacctccctgttacaacctacggggctgctcacctgccccggaatcccccaggtccagcttcaggggaggccagagtggcctcatggggaccttctgtggggaggggggctgccaaggccttgccctggtgcagtgtccgtggtggaaggataggtgaccccactacagggcccctgggagcctgcctgtctccagcagacccaggggacggggctccagggctgccccactctggtggggcttgtaggatgctggaggggtctcagggcagctgtaccttgtccttgttccttcatgagcctgactcatgctatggtcgctctgtgtgttggctgggcttcctggaggaggaacatttaggtctaggctctgtaggaagagaaggggaaggcagagacctcctcagcactccccactcctcctcggc

SEQ ID NO: 381803 - DNA, 335 bp, Homo sapiens
ttgaatgttatcttaaaaatggtggttcatgatccaggcgcagtggctcatgcctgtaatcccagcaccttgggaggccgaggcaggaagatcacttgagcccaggagctcaaggctgcaagtgagttatgattgtgccactgcactcctgcctgagtgccaggacaaggcctcatctctaaataaaaataaacaaaagataaaaatatggttcaatcaactccacatagtttcctggcaatattggtgaatttgagattttcttagttaaatgacctcttttcattttactaagttgtccatgtatcattgctttagaatgtcaagtccagaag

SEQ ID NO: 381804 - DNA, 447 bp, Homo sapiens
tgctgggattgcaggcgtgagccactgcgcccggcctaattttattttttgtacagatgaggtctcactttgctgcctaggctggcctcgaacttctagccacaagtgatcctcccgtttcagcttcccaaagtgtggggattataggtgtgagccacctcacctggtccaaccattttatttataataatttttccttcattcttagctgtgtgagcgtctgcaggcaaatacctcagcacaaggatactcagtgaagcattgcttttaagggaaaatgcacagaaacaatctaggtatttattgattggtgattcatacaatggaatactatacagcaaattaaaggaacgaggtagatttatatacgtggaaagataggcaagatattgttaagtgagaaaagcaagatgccaaacagcatgtacagtatgagttaaaaaaaaa

SEQ ID NO: 381805 - DNA, 2954 bp, Homo sapiens
ggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccatggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaagatttttgaattcagattatttttatcaggaacagattttgaacatcctgaaatcttttccctggcatcatattaggttttctttgttcactatgatgtaaagtttcagactcttgatatttttaatatcaacatagacggtaggacaaggaacggtaccagaaatgagtaaagagacaataatgataagatcgatttatcaagacataacaaccccaaatgtatatgcactaaataacagcttcaaaatacatgaagcaaaatggcagaattgaagagaatgagataaaaacagaattttaacgggtgct

SEQ ID NO: 381806 - DNA, 556 bp, Homo sapiens
ggtgtgcagtcaatgacaggatctgagggtgtccagacgcagattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381807 - DNA, 933 bp, Homo sapiens
gggctgtcatacgtcacctgcctgtggggcgagtgggaggcccagcctggtttagggaacaagagtgacgtgaggagtagcagggtgcgtctccagttacctgagggaaaacagatattttaagagataatagcatagcctattttaatatgttttaaaggccataagcatatccaggaagataaataaacgtgatacaatgtccacataggaggaactttctttcactgcattgttttccttcacagtggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaagatttttgaattcagattatttttatcaggaacagattttgaacatcctgaaatcttttccctggcatcatattaggttttctttgttcactatgatgtaaagtttcagactcttgatatttttaatatcaacatagacggtaggacaaggaacggtaccagaaatgagtaaagagacaataatgataagatcgatttatcaagacataacaaccccaaatgtatatgcactaaataacagcttcaaaatacatgaagcaaaatggcagaattgaagagaatgagataaaaacagaattttaacgggtgct

SEQ ID NO: 381808 - DNA, 4692 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttataaaaaaaacaatgagtacttcaatagaacatggataagcactggtcgataacaacgagaaaaaagcggggggggggggcccacagaaaagattccaactctctgggaggggcacaacaaatgatgaaggttgaccacgccgctttgtttgttgaaacaaaagcgggcccccaataaaagaggcggtggtaataaatcataaagcaggacgggcccgggttctataaaaacaacgcttgtgtgtgtgcgaacaaaaggtcacgccgtgcgaccactgtggtgaaaacgaacccacaacctgctgcggtggaagaaattatgtcgacacacatccaccagacagattaaacggccgccgggctattattt

SEQ ID NO: 381809 - DNA, 3900 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381810 - DNA, 4294 bp, Homo sapiens
accacatgcaagggtgaccaattttgtatttttcttcccagcagatgttaaagcaagaccaacagtctcccctcatggaaggcccactgatctaaaatgctggttccttttggaccttcagggcacttgggggagaccttcctgaggtgctgtgcagtgtctggtgtttctcagaccctggtggtcatgggagccaggcgtggctgagtgggctctacaggccctaggcagggagcatcgcctgtgctgtggctgacgttccttctggccctgttcccaaagttccccatgggggcctgggaggaatggcctttccagggggtgtttttatgagaaggaggtagctccctgttggagtgaggtgctcaggaggaaaggggcctggtcttagcagtcatgaccacctgtccccagtgaggaacatctctcctgccacacaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381811 - DNA, 4173 bp, Homo sapiens
tcctgacgaatgcggggtggtcctaggtgctgaggagagcgcgactggggcagtgggccggcggccggcgttggggcggggcctgggtcgctgatggccggtggtcctcaggtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381812 - DNA, 4258 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381813 - DNA, 2951 bp, Homo sapiens
tagacacttcgctctggccttttcagagaactggttattttttggaaatatcagttagatgtaggatgggtcttgtcttctaaatctattgttttctctctaattgattttttcctgtttttatttagttcactttgttgggtttgctcaagcctgggtcactggatctcagggatgctgctcctgtttgcagctgtgtctgcaggggcttcccaaggccttgctttcccctcacgtccctttctcagactctgccaatccgcttcccgctctggtgtcctgtggttgcttctttttaaaaccctcatcggtctgtgtaaactgtttatttttatgtggtttttaagggagaccattctcattcttttgagaccctggaaaggatggaattgggataggtaaactgctgttttaccagaatgttcactggaccaatctcgtgttccagggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381814 - DNA, 2406 bp, Homo sapiens
  misc_feature (75)..(76): n is a, c, g, or t
  misc_feature (162)..(162): n is a, c, g, or t
ttaactctcaggcctatgtacagaggcactgcgtgtctcaattctgtgcacggaggcgtctatattgtcagaganntgcccgagatcggcgcagaattcactacacaatccatgcgtgcggaccattgattgtggtgctgatctggccgacttcgggcattnctgaccatctgaagcgcctcgagtgacgagagtgacgtccaggctgtcgtacttgtgagaacaacagctacccgctaaatggctgtactggcccgtcggtatttacatatgctgggtgttcttcgatacaagatctctgtggcctatctccgtacatccgagcttactagggtgaacttcattccgctcaattcttgtggtccacttcgagtacgcgttcatcgctcaattcatgttagccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381815 - DNA, 3216 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggtactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttataagcctgtcacactgtgtttcg

SEQ ID NO: 381816 - DNA, 559 bp, Homo sapiens
  misc_feature (12)..(12): n is a, c, g, or t
gtgttgctgtgnttgctctagatggtccctgtcttgatgtcactgattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381817 - DNA, 966 bp, Homo sapiens
tagacacttcgctctggccttttcagagaactggttattttttggaaatatcagttagatgtaggatgggtcttgtcttctaaatctattgttttctctctaattgattttttcctgtttttatttagttcactttgttgggtttgctcaagcctgggtcactggatctcagggatgctgctcctgtttgcagctgtgtctgcaggggcttcccaaggccttgctttcccctcacgtccctttctcagactctgccaatccgcttcccgctctggtgtcctgtggttgcttctttttaaaaccctcatcggtctgtgtaaactgtttatttttatgtggtttttaagggagaccattctcattcttttgagaccctggaaaggatggaattgggataggtaaactgctgttttaccagaatgttcactggaccaatctcgtgttccagggagaccctcacgcagggcttagagttctgtcggcggcagcagagggccgatggctcctgggaagggtgagtgagcctccactcgtgagtgcagagatgcatgggatccagaggtttctgctctcacacactgcgttcataaatgttggcttgtatgttgttgctacaccagaagtttctggaagtgagctgccagcccgtgacttctgggggacctcgttcctttgtggcatgcgtggcctttgccccggtggaaattgctcagtacgttgctgggcgcagccgggctgctgggagcgcgctgtagcctgagcgtggctattccctccaccctttctgcttgctcttagggtccagcagacagagctgctgtcttccacggccttaatgcctgaggcactggagttggtgggctggctggggcacgtggatccacaatggcacgtggatcacaatggcacgtggatcacaatggcacgtggatcacaatggcacgtggatcacaatggcacgtggat

SEQ ID NO: 381818 - DNA, 241 bp, Homo sapiens
atgaacgtgggcctattactctcccccctcaggtggtgctgtggccatcccctcctgggggaagttctggctggctgtcctgaatgtttacagctgggaaggcctcaataccctgttcccagagatgtggtatgtctgctgttgattgggttgttgggtcgctgctgctgtcccggggagtagagtgacagggaccgtgggtcaggtgcaggctgtgacagcagagaggggtgggcattct

SEQ ID NO: 381819 - DNA, 4324 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381820 - DNA, 4392 bp, Homo sapiens
  misc_feature (4333)..(4333): n is a, c, g, or t
  misc_feature (4338)..(4338): n is a, c, g, or t
  misc_feature (4342)..(4343): n is a, c, g, or t
  misc_feature (4346)..(4346): n is a, c, g, or t
  misc_feature (4350)..(4351): n is a, c, g, or t
  misc_feature (4361)..(4361): n is a, c, g, or t
  misc_feature (4364)..(4364): n is a, c, g, or t
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttataaaaaaaanaacanaaannacnacanncacacacacnacnacacaccaccaccacacaacaacacaga

SEQ ID NO: 381821 - DNA, 4279 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcaccccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381822 - DNA, 3865 bp, Homo sapiens
  misc_feature (3788)..(3788): n is a, c, g, or t
  misc_feature (3791)..(3791): n is a, c, g, or t
  misc_feature (3793)..(3793): n is a, c, g, or t
  misc_feature (3800)..(3801): n is a, c, g, or t
  misc_feature (3806)..(3806): n is a, c, g, or t
  misc_feature (3809)..(3809): n is a, c, g, or t
  misc_feature (3812)..(3812): n is a, c, g, or t
  misc_feature (3815)..(3815): n is a, c, g, or t
  misc_feature (3819)..(3819): n is a, c, g, or t
  misc_feature (3834)..(3834): n is a, c, g, or t
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagattggttngcncntcatctnnttgcngcnagnctngggnccctgcttggtggcnggctctccgggggccttggttttgcggccgg

SEQ ID NO: 381823 - DNA, 4205 bp, Homo sapiens
ggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381824 - DNA, 3764 bp, Homo sapiens
gcaagatccacatgaggctgcccttgcctcatggagaggggcacacgtgactcccagagggtgaagcttcccagctagaggcagtgcagactttgctgacaggaagcagatgaacgtgggcctattactctcccccctcaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381825 - DNA, 4296 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatgtgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacaacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381826 - DNA, 2724 bp, Homo sapiens
tcccgtctgtgctgccctattaggtttgtggccatttggggaatcttcctaaaaccctaaaagctagggcaggtctgcttgagcaggagcagcagggtctgggggacccctgagggcaggacagtcagggacccacagttgagctgggcccgctgagccctggatccttcttggtgtcttatcctggccagcaagcaagtgtgagctcctgtgggtctccagaggcccatgaggaccagtgggccagttgggaacaaggcttggcgtcctcttcaggggggaacaccagggcaggcctgaggaggctgtgtccccagcctgtcattgctgtggctccgcttctcagggagcctaggaagaaggtgtggcaagagcccgaggcgctggctgcacctggcggggcctgtgggcgtcagtttagacccatccattctcactgcagcattccagggtttgcccttatgctcggctgtgtgagggtgaggatgatgctgtgggggcatgcatgctgggtgtgtttcagccttctcttccaccaggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttat

SEQ ID NO: 381827 - DNA, 2339 bp, Homo sapiens
cccttgcctactgctcatgggtgtggagactgatattctggaagactgataggcagatttactattaacaaacacatagtctgtggcccagcaaagccaccccaatccctgcacaagggtaaaaggccagcattagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaagggtgagtgagcctccactcgtgagtgcagagatgcatgggatccagaggtttctgctctcacacactgcgttcataaatgttggcttgtatgttgttgctacaccagaagtttctggaagtgagctgccagcccgtgacttctgggggacctcgttcctttgtggcatgcgtggcctttgccccggtggaaattgctcagtacgttgctgggcgcagccgggctgctgggagcgcgctgtagcctgagcgtggctattccctccaccctttctgcttgctcttagggtccagcagacagagctgctgtcttccacggccttaatgcctgaggcactggagttggtgggctggctggggcacgtggatccacaatggcacgtggatcacaatggcacgtggatcacaatggcacgtggatcacaatggcacgtggatcacaatggcacgtggat

SEQ ID NO: 381828 - DNA, 375 bp, Homo sapiens
tcgggacttgcggaaccccgggttgtgttgtgaatcttcgcgtggttcaattccttcctttattgctctattgcttgctttagaatttagcacactgagcccttcatgaatgccattccatgctgagcctttgagagtacaggtctgggatcctgggctctgtctagaaaattctctgatctaaaataccaacaaggatggaagcctttgggtctccctgtgcccatgcttctttctagctgccctgggcctgcagacgcaggcagagagagcttcgcagaggaggaggtggaatgaggattgctgggaagcaggcactgtgcccagcgcctctcaggatacatcctccacaggactctgcatggggaacagcgc

SEQ ID NO: 381829 - DNA, 279 bp, Homo sapiens
acccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgcgggctcgggttacagatggttgaggcacctcctggccatccccag

SEQ ID NO: 381830 - DNA, 486 bp, Homo sapiens
gctgtggcatttcctcacctcatcctctgccgctggtataaagatattacagtatcgattcccagcactgcacggcttctgggtccattcatcactgcctggggctggagagcaattattggggtcattgcttgtcctcctgcaggagcgcgggccctggaagcccaggacctctctggagaagggcagggcccggaggagtgcagccagctgagtgcttcccagatgccacccaggggaccccacgaaaccccctcaggcaggtggaaaggcctcagggtggctgggaagctagggcagctctagaggacgtagagcttctgcagcccagcacacggcacagctgacttcagagcttgctcaccgtgcctgcgggtgaatggccacttcgccgcagggagggctggtgcctgcctgggccactcggagctgtccaggtctgcacccagagctggctctttctccccacactccaccgtcctgacc

SEQ ID NO: 381831 - DNA, 355 bp, Homo sapiens
aatctcatagctactgggtctactccacaaggaggaaatcaagactggtaagagttggctacctgacctgtacttgcaaaacactgacacaaatgagagagagagagaaaaaaagaaaaccaccacctttactcactcaagtaataaggtcacctcagaacactggcccatgttttgaaaggaaataatttttagaggtgaaaaacaatggttgataggtaccaggcataaccctttgagatgcaagtactattgccaattaatgccattggacagatgagaaagttaaggctcggagcaatcccataagctgcctacagttacatagcccagtaaaagccagagctggtatttg

SEQ ID NO: 381832 - DNA, 314 bp, Homo sapiens
actccatgtcttttctccctctcttcaaataggcacagagaagggaagtgggcatgggataataagcaactctaacacacaagcagaggtccaactgagaggtgagataccagtcttcccttcttactaatcttttagatgaactctcgcttgatttggactctcagcaacagcactattcagctacattaagtcagtgaagcaaactctgatgattgcctcatgatggggacaggagaaggcacttctggataaggaagaactaaggaaggtaaagatgtttaagttatggaggtggagttggctctcatttg

SEQ ID NO: 381833 - DNA, 556 bp, Homo sapiens
ccgtggaggaatactatgtgcccaggcaggagtgtgctgtggcgccatcttggctcactgcaacttcctctttccagtttcaagagaccacagcctcccgagtgctgggattacaggcctgagttactgcacccggcctgtccccgaaattcgattgcagccggcgataaagcttttttttaccccgcttctcggcaaagcgttgtgtttttattttagcagactcacctggcactaaggactgctctggtggtcttcggaggctcctgggatcgactgcttggacagaggtgacatcacccaggtagtgagagccaagacctaaggctgcagctgccttccaggtatctgccactcactgtagaacgatcccacagttctgcatttctgccctatgcccgccagtcacaagaagctccggtctcttatcccatgtctgattcctgaaaccttgctaattttcctaccatcctccctattcccagcctcctttcttcttcttcttcttcttcttcttcttcttcttcctcttcctcttcctcttcctcttcctctt

SEQ ID NO: 381834 - DNA, 297 bp, Homo sapiens
atgcttggtgaggggcaacctttgctgtcctgaagtcttaggatagggaggatagggctgtcccagtggccactgctttggcccacaggaatgagacttgctttcgtctcacaccccagtcccagcaaagttccctcctccatcctggctatggcagccaacttggccacccagtcagtcctggcaggctgcacctagtccacaactcagtcctaggccataggagatgccattcagcttaaggccaagcctccacaacaactctcctcttgcttaggacctgggatggtggtgtgc

SEQ ID NO: 381835 - DNA, 395 bp, Homo sapiens
ccccgcgggcctcccaaggcagccccctgttagcccgaccggcttcgaagcccgcgccggttgcggatcctccgccgcgcccacctgtcagcgcctcggccggccggggctcccgccgcatgcaagcagcgaggcgaggtcgcgctgaggcctggccatgccacggacggccgggcctcaccctgccgctctctcgccgtccagaggcccctgctccacacctgggtaccctgggtcctgactcagggcagctgggtgagaagctaacggcctgaaggaacagggctacaaggggagtttgtgctgggcctggcgtcccaggctgtggactggaactggacatgagaacccccctacaccctcccaagtcaaagacactccaaaaagacagtttc

SEQ ID NO: 381836 - DNA, 392 bp, Homo sapiens
cttcgcccagtgtcctgcggccgggcccggcggattcagaatgggacctggcgttctgagacacagccccagtgccggtagtggggggtggtggactgcactccggggccatttaatgtctttaggccttgagtctcggcttcggtcccagtcaacgccaacgggagaggaaagaggaaccaagtggggtccccagacttccaagcaaggtgggctggctaacgtccctcctacctgtcgcagggcagctgggtgagaagctaacggcctgaaggaacagggctacaaggggagtttgtgctgggcctggcgtcccaggctgtggactggaactggacatgagaacccccctacaccctcccaagtcaaagacactccaaaaagacagtttc

SEQ ID NO: 381837 - DNA, 242 bp, Homo sapiens
tccactttattagcctggagctcctccctgccagccccaggggctggtcgctggtccctgggcacagtgagcagggctgaggtcagacgggttcggcccttggccatggcagcttggttgggacagccgggccaagggaaaaaaaggtgcaaaagtccaaatgctggcacttcaggtgtggccggcacccagccaggcgcagtgggtgggcagggcgccatgcttctctcctggcgacaggt

SEQ ID NO: 381838 - DNA, 2317 bp, Homo sapiens
  misc_feature (1090)..(1090): n is a, c, g, or t
  misc_feature (1401)..(1401): n is a, c, g, or t
  misc_feature (1629)..(1629): n is a, c, g, or t
accactttgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaaggaaacagcagcagagtgcaccaaccaactggtatgaatcaagctccagtggaactggcccactttgtggggtctgatgcacccaaagtgcatacccaaaacttggaagtgagccacccagagtgcaaagcacagatgctggagaatcctagcatccagcggcttctgtccaacatggagttcatgtggcagttcatttcagaacatctagacacgcaacaattgatgcagcagaacccagaagtttcccgccttcttcttgataattctgagatcctattgcagactctggagctggccaggaaccttgctatgatccaagagataatgcagatccaacaaccttcacaaaaccttgagtatccactgaacccacagccatatctgggcttagagacaatgccaggtgggaataatgccctgggtcagaactatgntgatatcaatgatcaaatgctgaacagcatgcaagatccttttggaggaaaccctttcacagctctcctggcaggacaagtgctagaacaagtccagtcttcacccccacctccaccaccatcacaggaacaacaagaccagctcacacagcatcctgcaacccgagtcatctataatagctctggtggtttctcttcaaacacctcagccaatgacacccttaacaaggtcaaccacacttccaaagccaacactgctatgatttccaccaagggccagagccatatctgtgccactcggcagccagctnggataccagccttacctagcatagagcttacccagcagcttcaagaagaatacaaggatgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaanagtggaggcagcagctgcccacattcctgcagcagacacagatttctgatctgcttagtgcttaggcaaccctaaagcattccaagcaatattgcagattgagcaggccctccagctgctggccacagaggctcctgttcttctgccttgggttgcaccctacctatggggcctgggttggcttcctgcccccagctgcagctatcctgacacagtgccctgttcctggaatgtttcagatacagctgagcccaagggacctgagtgctgccacaagcctggaacagtcctgcagaggctacaatccccggatggggacccttcccaccctctgcaagctcctgagatttgttttagcaaacagatggattctctccaggccatgggatttgggaaccaccatgccaatctacaggcactcattgctactgaaggggacaccaatgctgctatccgcaagctcaagagatcccagagattctaaccaccatgcctacttgtttgcttgctacctgcctgctgacccacctgaccatctcatttgccttttgcacctttcctgatgcttccagccaggagaagtcctggaataagagttatcaaccaatgtgtcttgtactgaataatagatcattggtcgtggctgaaacatctgtcaataaaatggctacactcacttgctgcgatc

SEQ ID NO: 381839 - DNA, 385 bp, Homo sapiens
aaaacataaattgaggcaaggacaccctatttaataaatggtgctgggaaaactggatagccacatgtagaagaatgaaactgaatccctgtctctcactttacacaaaaataaactcaagatggataaaagacttaaacctaagacctgaaaccataaaaattctagaatataacctaggagaaactcctctggacattggcctaggcaaagaattcatggctaagactcctaaagcaaatgcaactaaaacagaaataaataaatgggttgggcgcagtagctcaggcctgtaatcctaggactttgggaggccaaggtgggcagatcccttgagcacagcaggtcgaaaccagcctgggcaacagggcaaaacgtctctaca

SEQ ID NO: 381840 - DNA, 406 bp, Homo sapiens
ctgtattttaagatggacaaaaaaaatactttcttacattttgccttccaaactcttcgtagtatgtaaaactcctagggcaaaatgtcattttcaatgctttgtaaaaagaatacttgatattggccaggcacagtgtctcacgcctgtaatcccagcgctttggaaggccaaggcggtcaaatcactaggtcaggagttcgagaccagcctggccaacatggtaaaaccccgtctctactaaaaatacaaaaaattagctgggcgtagtggtgggtgcctgtaatcccagctacttgggaggctgaggcaggagaatcgcttgaacccaagaggcggaggttgcagtgagccaagatagcgtcactgcactccagccctggtgacagagtgagactccatctaa

SEQ ID NO: 381841 - DNA, 270 bp, Homo sapiens
tggggtgatgaaaatgttttggagtcagatagaagtaatgattgtataacaatatgagtgtactgaatgccattgaattgtacactttataaggatgacttcatgatgtgtgagtaaagttattagccacaaaagaaagaaggaacataatattaagaagtgctggggatgtattggacattgggtcagctttaccttactctaaactaattttcatgaaaactccattcagtaattactattaaaaacccacttgaagctgggcacggt

SEQ ID NO: 381842 - DNA, 369 bp, Homo sapiens
atgtgtttgtgtggcggggggcaggttgtacttttaaatagtgggtcagggcagaactcactgtaaaggtgaggtttaagcaaaggcttgtaggaggtataggaagagcgttccagacaaagggaagggccagaggaaaacagatagaggcatggtcagacagctcgaggagtagcctggagaccagtgtggtggggcagagtgagaaggggaggatggtgggaggtggagaaacagaggtgagggtggggaattggtggggggtagggaagactcaaggcggacaatctggggcttgtgtccaaaatggtagccagttggctacctaaagcattaaataaaataaaaacgttcagtttcttagtcgta

SEQ ID NO: 381843 - DNA, 415 bp, Homo sapiens
acagctaaagactaatggtcctaccttgcatgtagcaactggaagacactggtgactgatgaaaacagaagggtggccaggaagccagacaacatttagactggtgagtgagtaagtagtgaagacttgaaccgatgaatatagactaccatttcaagaaacttgactttcaaggaaaggagaggaatgaagtagttagagctaggtttgatctcttaatgctattcacttggcatagaatgccatttatttcctcaatttgcagtcctccctggcagcctgcctgtcttctccctctcctccctgcccctctccctgtcctcattctctcccttcccctccaaaccatctagcagtcggtttttaaacatctatcaaacctgacctcttttttccattttcctaataaactcta

SEQ ID NO: 381844 - DNA, 1287 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaat

SEQ ID NO: 381845 - DNA, 1505 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaat

SEQ ID NO: 381846 - DNA, 1166 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccagagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaat

SEQ ID NO: 381847 - DNA, 3787 bp, Homo sapiens
  misc_feature (106)..(106): n is a, c, g, or t
  misc_feature (1275)..(1275): n is a, c, g, or t
  misc_feature (1866)..(1866): n is a, c, g, or t
tgctttttctttgttttatggtgatttttactttttcaagtagcttgttaaaggagaaatcagaaatgcacatgattgttttatacagaggtataaagctataaangaatgtgttgactgattcagctaacttagaaaataaaccaggcataagtttttagatgatttaattacatggtgtttagagctacttacctatggattgattcaattgctttcacgtatcataagcttaggtagatagcttttagctaacattcatttgataagcatagtgttttaaaaattttctgacttatgtaagtattctttcattttacttttaaaggagaagaaatattctaattttatatttattaagaatattttctctactgaaattgtaacttttaaaaaattgaggtaaatggaataatggtctataatttttttagtttctaaagattattttctttggaaaaatctcaagatttttggatgggcaagaaatttaaagtaatttctttaattgttttaaaattagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccagagtagtgttaatttgtttgtgtgtttgtttgttgttaggtttgcagtgaggtgtacctgcttgccttctgattttaatagattgcttcataaagcagacagaaaggtaaggagataggtggggaaggtatcagtgcttactttttgcattagcttttgagagcaaaacagtaagattattgactagttgcctaaacctggcactttccatcatcttctgtctctagcctagcttcctgaacagggccaggatggcattgtggtggtatactagctttggttgaacaagaaaatgtgaacagcttggaaagtaatatacttttcttaaagccgtttatttactgttaaagtctatgaatatgacatttgtggtaacttacattttttcattgtcttcattctatcattccaattttctagaaaataaaattttatgtaataggaaaacactgtagtattatgaaaaggttttgtggcttttaggattttgaggatacatatacgttagatacatatacatacatacacagttgctttgagaccttcagaaggctaagttaggttccttaacatactctcataaaatacttcttactnctcttttgtaattcttataagagttataataaattaattataagttgttattaatttgttttacatgctctttgaaggcagggactatgctttgtattccctagtgcctagtacggtattataaaataggtagcaaatatcagtaactgttattcagaaatgataattactattagttttactgtatttatatgagagttatttcatattgagaatttgcaaagtacttctgcatgccttatctcatttgatcctcataagaattctagtgttattttcatttaacagataataaaactgagatctaggttacttatggccaagggaacacagtaaatacaggagtgggatttgagtcctggtactccagggccagtgctcttcactgttaggttaaactgattccttagagagtagaaaaagattttgtatgatactaaatttcaaaagatgttactgtctatgtgcttccattatgagttaaaaatcttactggttctttcattgatgtctcactgtgtgtattaccattttcctcttttattctggttattattttcatgatgataagccatagtgggtagaaggatnaaatgttggatcacttgtctcatagaatcacctgtggtttaagaaagcttaagggtcattattttaagcaaaagaacatacagattttcatggcttttgtttttatcattatttgggattttgaacttctgaccaagtgtttagtaatttcacaccaaccttgtcataattgttgcacacataatttttatatgctgagttttggactcaacaatgtatttgttattttggatgtatgatttggagagaagaggtgcatttattatttatttgtaacacttagtgacctatacatttcaaagtttaatcttttaaaaattaagttaataaaattaattttaccaacacatactaaataaaattgattttgcatgatataattattcagctgatattgactgaaaccatttttgatggataatgttatttcttctttgcttttaaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381848 - DNA, 1082 bp, Homo sapiens
ctagtttgtggctgggcatggtggctcacacctgtaatcccagcactttgggaggctgaggtgggtggatcacctgaggttgggagttcgagaccagcctgaccaacatggagaaaccccatctctactaaaaatacaaaatattagccaggtatggtggcatgtctgtaatcccaggtacttgggaagctgaggcaggaggattgcttaagcccaggagttagagaccagctcaggcaacatagagagaccctgttcccctcctgttatccccccaaaaaagaaaaaaagacacagcgaacgcacaggacagcaccaataaaaacttggggtggcagcctatagcattcctttcaaaattcttatattgattgttttaggtagttcagctcccattggtatacctctattcatggttgctctttctgcatacccttttcccatccatccctaattaaaacttttgtactgtcaccagtcttctattttttatgcctaaattatgtcttgccccagtgtgcctaaaaaaaaacaaaaacaaaaaaaactcatgatttggaaatttggagacttctgaaagtcaaaattagctctaaattgatttttgataccagaattttcaaaaaagtaaccaaattagccagatttggaatttcagttctttatgttctttttatccaatttaatggaagtataacgtactctaaaatggtagaatcatgtagctgtggagaggatgatgggacaaataatacaaagtgggtaatcaactttaaaaatgacaaagctaaaaaattaatatgtacaagcagtttgcgtggtaaaggtctgtctatatctatgacgttttcttgggaatcagagtgcttaacaattctcatccagagaacatgtgttcgtaaatgcatatattatatgttaaatcagtttctctttatacagatcaagtagttggatagaaggataatgttagttgcaattacttcattaaatagcatatacttttattttttattttattttttttgagacggagtctcgctttgcctcgcaggttggagtgcagtggcgccttctcggct

SEQ ID NO: 381849 - DNA, 3848 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381850 - DNA, 2779 bp, Homo sapiens
tttttttagaaaaaagtttttaatttttgttggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381851 - DNA, 3782 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381852 - DNA, 2155 bp, Homo sapiens
  misc_feature (106)..(106): n is a, c, g, or t
tgctttttctttgttttatggtgatttttactttttcaagtagcttgttaaaggagaaatcagaaatgcacatgattgttttatacagaggtataaagctataaangaatgtgttgactgattcagctaacttagaaaataaaccaggcataagtttttagatgatttaattacatggtgtttagagctacttacctatggattgattcaattgctttcacgtatcataagcttaggtagatagcttttagctaacattcatttgataagcatagtgttttaaaaattttctgacttatgtaagtattctttcattttacttttaaaggagaagaaatattctaattttatatttattaagaatattttctctactgaaattgtaacttttaaaaaattgaggtaaatggaataatggtctataatttttttagtttctaaagattattttctttggaaaaatctcaagatttttggatgggcaagaaatttaaagtaatttctttaattgttttaaaattagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381853 - DNA, 3553 bp, Homo sapiens
  misc_feature (2733)..(2733): n is a, c, g, or t
  misc_feature (2760)..(2761): n is a, c, g, or t
  misc_feature (3375)..(3375): n is a, c, g, or t
  misc_feature (3403)..(3403): n is a, c, g, or t
  misc_feature (3440)..(3440): n is a, c, g, or t
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattatagaaaaatattcaatgaataagcaaaaatgtncacatttatcattactattgttttttnncttctcaaactcaaatccaaaacattgctgcatcttttgaccaggaggcagctgccattcttatggcccggctagcaatatatagagcagaaacagaagaaggtccagatgtgcttaggtggctggacagacagctcattcgactggtaagaaataaacactgtgcttttctaaatctgtatgctttcatttgtagtaaatgtttgttgcagataatctctttcaaagtacttaacagtgtatctgaaatactgtatgagaaactcctattcaaattactgagacagtagcacagtaatgaatagtagaactcattaatctcttccagtaaactagattgccttttttccttaaaatgtaagagtgacaattatgtaacctattatttttctattcttattggctggaatgaggttagttcccaatttaattctatattattgtaacaatttttagtgcttttttacatatttcttcattgctgtggctttagttctttactttcattttaatggaactattatatgtgcatctcttaaaagaaattaggccaggaatggtggctaatggcagtaatcccagcactttgaaccaggagttcaagatcagcctgngcaacatggcgaaacccctgtctctccnaaaaaaattgcccagcatggtactgtgtgcctgaatnccaactacttcaaaacttactcactaacatcactacaccaattaattttatactttataaatcgtcattaacctactcatcgcaacctcgtcatcatattaacctcttttgaa

SEQ ID NO: 381854 - DNA, 2688 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagatacatcctgaagtatttaggaataaaatgtcatgatggcttcaacttccagaagttattcaacaaaaagaagaaaaaaggaaaaataatgtagaaacataaagcatacgtggcaaaatgttaacagtcagtgaatgtaggtatgctatatgggtgtttattgtacttctctctcaactttaatgtagtcttgaatttttaaaaaaacaagtgttggggataacatacgtgttgggcgatacatcac

SEQ ID NO: 381855 - DNA, 745 bp, Homo sapiens
  misc_feature (37)..(38): n is a, c, g, or t
ctttgcaaaataatcaccaaaggaaagagtacttttnntcattaccacagatcctctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381856 - DNA, 693 bp, Homo sapiens
agaagttgagtatttatttggtaagtaatggagagtcattgaaggtggacagagggcagatttgagtcttagtatagttgaatcttaagattaaatggaagcagtctgtaggttgaaagtatatttacgaaaataatccaagtgagagggagtaaaggcaagatggtgaaaggaatagatttgggagatattttaaaagtagactcaataggacttgattagaagttgcaggaaagtaattattccagggcatggcaactatgcacaaaatctgaattctgattgaatcctggattaaagggagagaatagctataaagaacataattgggataatttgtgagatttgaatatagatcatatatcagataactagtacagaattattaaatttcttgagagtgataatggtgtggttatgtaggagattcttcttgatcttaggagatacatcctgaagtatttaggaataaaatgtcatgatggcttcaacttccagaagttattcaacaaaaagaagaaaaaaggaaaaataatgtagaaacataaagcatacgtggcaaaatgttaacagtcagtgaatgtaggtatgctatatgggtgtttattgtacttctctctcaactttaatgtagtcttgaatttttaaaaaaacaagtgttggggataacatacgtgttgggcgatacatcac

SEQ ID NO: 381857 - DNA, 156 bp, Homo sapiens
aaacataaagcatacgtggcaaaatgttaacagtcagtgaatgtaggtatgctatatgggtgtttattgtacttctctctcaactttaatgtagtcttgaatttttaaaaaaacaagtgttggggataacagggtattttggggttttaagcctga

SEQ ID NO: 381858 - DNA, 3794 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaactgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381859 - DNA, 5480 bp, Homo sapiens
  misc_feature (2968)..(2968): n is a, c, g, or t
  misc_feature (3559)..(3559): n is a, c, g, or t
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccagagtagtgttaatttgtttgtgtgtttgtttgttgttaggtttgcagtgaggtgtacctgcttgccttctgattttaatagattgcttcataaagcagacagaaaggtaaggagataggtggggaaggtatcagtgcttactttttgcattagcttttgagagcaaaacagtaagattattgactagttgcctaaacctggcactttccatcatcttctgtctctagcctagcttcctgaacagggccaggatggcattgtggtggtatactagctttggttgaacaagaaaatgtgaacagcttggaaagtaatatacttttcttaaagccgtttatttactgttaaagtctatgaatatgacatttgtggtaacttacattttttcattgtcttcattctatcattccaattttctagaaaataaaattttatgtaataggaaaacactgtagtattatgaaaaggttttgtggcttttaggattttgaggatacatatacgttagatacatatacatacatacacagttgctttgagaccttcagaaggctaagttaggttccttaacatactctcataaaatacttcttactnctcttttgtaattcttataagagttataataaattaattataagttgttattaatttgttttacatgctctttgaaggcagggactatgctttgtattccctagtgcctagtacggtattataaaataggtagcaaatatcagtaactgttattcagaaatgataattactattagttttactgtatttatatgagagttatttcatattgagaatttgcaaagtacttctgcatgccttatctcatttgatcctcataagaattctagtgttattttcatttaacagataataaaactgagatctaggttacttatggccaagggaacacagtaaatacaggagtgggatttgagtcctggtactccagggccagtgctcttcactgttaggttaaactgattccttagagagtagaaaaagattttgtatgatactaaatttcaaaagatgttactgtctatgtgcttccattatgagttaaaaatcttactggttctttcattgatgtctcactgtgtgtattaccattttcctcttttattctggttattattttcatgatgataagccatagtgggtagaaggatnaaatgttggatcacttgtctcatagaatcacctgtggtttaagaaagcttaagggtcattattttaagcaaaagaacatacagattttcatggcttttgtttttatcattatttgggattttgaacttctgaccaagtgtttagtaatttcacaccaaccttgtcataattgttgcacacataatttttatatgctgagttttggactcaacaatgtatttgttattttggatgtatgatttggagagaagaggtgcatttattatttatttgtaacacttagtgacctatacatttcaaagtttaatcttttaaaaattaagttaataaaattaattttaccaacacatactaaataaaattgattttgcatgatataattattcagctgatattgactgaaaccatttttgatggataatgttatttcttctttgcttttaaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaatttattttgcttaccacagtgttatagctggttctagaaatttgaagtctttataacttaattatgtttaataaaaaatagagtctgcctcgtactacagatgtaactcatttgtatattgcagacagacccaaagtggcactgaattttcttgctcaccttttaaaaacttgttccttaattttagccagaaagcaaaaaaacaatagtaatgataaatgtgaacatttttgcttattcattgaatatttttctgtaattttcagcacttatgtatacactttttctgtacttactaggttaaggcagatttatttttatgatttgtttaggaattatttgattttataatggtaattttcatgatgataatgtttttggttatttggaaagatagtttagagatgaaaggtttttttgggtaacaatcccgcagctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattgataaagccagatatgttttgacaatgaaatttacatatcaagtactgcaaataaaaggtggtgctatgatatatgcttaggaggacagttttaatgattgtacttgcatgaacacaatcatatgatggtaaagcagaaacttaagaaaaaattgtttatgtgttatattcaattagcttaaataagttgctttgttatattttatttgaattgaactacgctaggcctaaatgccaataaaatatacttttcactgtt

SEQ ID NO: 381860 - DNA, 2980 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgagataggaacaggtggcacatgtcagtggaagatatgtggacttagtcccactacaaccttagccatatattttgaggttgtcaatcagcataatgctccaattcctcaaggagggcgtggtgcaatccagtttgtgactcagtatcagcattcaagtgggcagagacgcatccgagtgaccaccattgctaggaactgggcagatgctcaaactcaaatccaaaacattgctgcatcttttgaccaggaggcagctgccattcttatggcccggctagcaatatatagagcagaaacagaagaaggtccagatgtgcttaggtggctggacagacagctcattcgactgtgtcagaaatttggagaatatcataaagatgacccaagttccttcagattttcagaaactttctccctttatccacagtttatgtttcatttaagaagatcttctttcctgcaagtttttaacaatagtcctgatgagagttcatattatcgtcaccattttatgcgtcaagatctgacccagtctctaattatgattcagcctatcctgtatgcgtattcttttagtggaccaccagagccggttcttcttgatagcagtagcattcttgcagatcgtattcttctcatggacacattcttccagattttgatttatcatggtgagaccatagcacagtggcggaagtcaggataccaggatatgcctgagtatgaaaatttccgccaccttctgcaagccccagtggatgatgcacaggaaattcttcactccagatttccaatgccaagatacattgacactgaacatggaggcagccaggcccgtttcctcctttcaaaagtcaacccttcacagactcataataatatgtatgcctgggggcaggagtctggagcacctattcttacagatgatgttagtttacaagtgtttatggatcacttgaagaaacttgctgtgtccagtgctgcttgaagtgctaataatgttaaagacacttaagaagatgaaataatattcaaatttcattttttcctttttccatttatctgtggaaaccaacagatattgctctatattttttgtattagtatggtttgagacaacatatggaaaatgttcacatttgtagattaagctggaattataatgagagcaataagaacaaaaaaaaaaaaaaaaaaaaaaaaaaaaaatgtgtgtgtggggcccgccggcgcaccccggaaaaagttttccaaaaccattctcgtgggcgcgcgcggcgcccagaggttaatgggaaactggcccaacggccccaaggaaacccggccccgcactggcgcggcgtccccccaaaaaaaagcgcggcggaaccggggtcggaacaatccgagggtccgggcacgggcccaccgggtcccaggagtgaagacccgccggga

SEQ ID NO: 381861 - DNA, 2510 bp, Homo sapiens
agcgggtggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaatgaagaacgagatggagtccgatttagttggaatgtttggccatcaagtcgactggaagctacaagaatggttgttcctgtggcagccctgtttacaccactgaaagagagacctgacttaccacctattcaatatgaacctgttctgtgtagtaggaccacttgccgtgcagttttgaatcctttatgtcaagtggattatcgagcaaaactttgggcttgcaacttttgttaccaaaggaatcagtttccacctagttatgctggtatatctgaactgaatcagcctgctgaacttttacctcagttttctagcattgaatatgtagttctgcgtggtcctcagatgcctttgatattcctctatgtggttgatacttgcatggaagatgaagatttacaagccctgaaagaatccatgcagatgtcattaagtcttttaccacctacagctttggttggacttattacttttgggagaatggttcaggttcatgaacttggatgtgaaggcatttcaaaaagctatgtcttcagaggaacaaaagatttgtctgccaaacaactgcaggaaatgctggggctctctaaagtaccagttactcaagcaacacgtggtcctcaggtacagcagccacctccttccaacagattcttacaaccagtacagaaaatagacatgaatctcacagatcttctgggagaactccagcgagacccttggcctgtaccacagggaaagagacctttgcgttcctctggggtggcactttccatagctgtaggactgctggagtgtacttttcccaacactggtgctcgtatcatgatgttcattggtggtcctgctactcaggggcctggaatggtggttggagatgagttgaagacacctataagatcgtggcatgacattgacaaagacaatgccaaatatgttaaaaagggaactaagcattttgaagcattggctaatcgagctgctacaactggccatgttattgatatctatgcgtgtgcattagatcagacaggtctcctggagatgaaatgctgtcccaaccttactggaggatacatggtaatgggtgattctttcaatacttccttattcaaacaaacttttcaaagagtctttaccaaagacatgcatggacagtttaaaatgggctttggtggtacgctagaaataaagacctcaagggaaataaagatttcaggagctattggaccctgtgtgtcactcaattctaaaggaccctgtgtgtctgaaaatgtaagttgtgtttattctaaaaagaaaatacaggaccaggaactgtggcttgcacctgtaatcccaggtacttgggaagctgaggcaggaggattgcttaagcccaggagttagagaccagctcaggcaacatagagagaccctgttcccctcctgttatccccccaaaaaagaaaaaaagacacagcgaacgcacaggacagcaccaataaaaacttggggtggcagcctatagcattcctttcaaaattcttatattgattgttttaggtagttcagctcccattggtatacctctattcatggttgctctttctgcatacccttttcccatccatccctaattaaaacttttgtactgtcaccagtcttctattttttatgcctaaattatgtcttgccccagtgtgcctaaaaaaaaacaaaaacaaaaaaaactcatgatttggaaatttggagacttctgaaagtcaaaattagctctaaattgatttttgataccagaattttcaaaaaagtaaccaaattagccagatttggaatttcagttctttatgttctttttatccaatttaatggaagtataacgtactctaaaatggtagaatcatgtagctgtggagaggatgatgggacaaataatacaaagtgggtaatcaactttaaaaatgacaaagctaaaaaattaatatgtacaagcagtttgcgtggtaaaggtctgtctatatctatgacgttttcttgggaatcagagtgcttaacaattctcatccagagaacatgtgttcgtaaatgcatatattatatgttaaatcagtttctctttatacagatcaagtagttggatagaaggataatgttagttgcaattacttcattaaatagcatatacttttattttttattttattttttttgagacggagtctcgctttgcctcgcaggttggagtgcagtggcgccttctcggct

SEQ ID NO: 381862 - DNA, 799 bp, Homo sapiens
tttaatagtatgagcatggtcattgaatgacttctatagttcattgctagaatagctaaaatattttggagaactagaacagaataactggaatttccctaacaattttaataaaaagtatgctggtgttgattcagtattggacaataagtggaaagaataacattcggaaataaacattcagaagataagcccagtatatgtaagaatctaataagataaatatatttcaaattaatagggaaattatagttattctacatttacagaagattttggaagaaggtgctggctatttgttatggggaaaggatggattaattgctaccccatatttaagtatgttcttttttccttttttgtaatggcagtttgtcagtgtgaaataaaatgttcttttttaattaaaatctaaattaaaaattaaacatggagacaaaaggaaaataggctggcatttttacagtgtcagggtgggttagcaaagacatgatatcagaagcagaaaataaagtgatccgtttgactaaatagaaacaaaacatatagcagagacttgtaaataaaattgaaggcaatcagtaaactgggaaaatacatttgtaattttattgacaaggggtcaacattcttactatttaaagagcccttacagatgaagaaaaagaccccaacacctcagtagaatgcaggctgaagaacatgagccagcagttctcacaggactaaatataaactacacatatatagatattcttttgatttaataatcctacatgtagccatttgttctaatagc

SEQ ID NO: 381863 - DNA, 365 bp, Homo sapiens
aacttccttggcttgtttaacttacaaaacctttcgaaatgcagtttgctgtgcctgtgtttggagtgtttagttttgtagaaaaaaagaggtgagaagtagaataacatttacattgattttcttcaaggttgtgctctactgagaaatagtattttgtcttactaaagcacatgtttaagaaatggagattgctgtcttgcaaaacccccaatataaactccagcaggctaaaatgcctgtagcctctagttgattataattctgtaccaaatcaaaagtgactgcatttaaaaacttccataaagaaaagcttagacatttcaaactaatgcttggccaatgcaaaattatttattccttcc

SEQ ID NO: 381864 - DNA, 669 bp, Homo sapiens
gagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttctccctgcctttcctctgcctcctcccctgccagccctagcgtgactacccagagacaaaaaaaaaaaaaaaaaaaaaag

SEQ ID NO: 381865 - DNA, 786 bp, Homo sapiens
taacatgaaagtgaagtgtctaaagcagggagatctggaattccactagcctggttcggctcttttcatttttctgagctcctttgcagcacctggctgggcgccgacgtagttttacagcattgagactgtagcctggatcactttgaaatctttttctttttccttttcatacaatatcaggaaattttcagtgatacagttgtcatgaatgtcgccctgcaaatgccctaatgatccctctgtggacagaccaaagttgacccgttggctcttgcagattcatttttgttttttgtttttgtctttgtctcacttgaatgatttcattaggattactcctgagaagtaggattgctgggccaaagggcacacagacttccccctttcttaaggaattttgctaacttgctttgcaaaagagcccctgactctgcatggccccccggggcagccgcgggttcctttccccacagccgtgccagtgccagccttgagtctgcgtgaccttgagccgcagggaagcggatgagtggccagcagccctctgctcctgcctcctcactgtgtgcacgcctttctgcaaatgccgctgcccgctgccgtgcgctccgcttccagacagtaattgttacaagacctctaactgcctcgacgaccacatggcccttaaaaatggtcatttcccccgtgagcattttctcttcatcgaaaccactttgtttatacttgctggtgacagtgtgactgtggacttgcctccagtttggttttctccctagttat

SEQ ID NO: 381866 - DNA, 491 bp, Homo sapiens
gaggcacaagaatcacttgaacctgggaggcagaggttgcaatgagctgagatctcgccattgcactgcagcctgggcaacaagagcgagactccatttcaaaaaaaaattatctgggtgtgatggcacatacctgtagtcctaggctctcttaggatgatgaagcaggagaattgcttgagcccaggagttcgagattgcagggagccatgattgattgcaccattgcagtctagcctaggtgatagagctaataattatgttatagaagaggcattaacttcaagataactaagtgaaagcctggtattaacaaattttaaaaagtaacaaataaataatgatctaagctacccagattagtttctggaaaatttgtttaaccaagacaatctccaagggaagtcaggctaataattgtgtctcagccattactctgcttttaggagggaaggtacaggatggagtgagaaagaaaagaaaaaaaatca

SEQ ID NO: 381867 - DNA, 1723 bp, Homo sapiens
tctaattgctttactacattttctcatttagttctcaacccaaccaaggaaactggagaatacacagtgaggagtagagccaggatttaatcccaagtattctgactctagagccagcagttttaaccattatatcatattgcttgttaagctgtaggttaaacatggtatataattttattttttgtttttgttttgagacggtctccctgccgcctaagctctggagtgcagtggttccatcaatatcctgagctcaagcaatcctcccgccttagcctcccaagtagttgggagtataggcatgagctaccatgcccagctaatttaaaaaaacaaattttttttaagagatagggtcttaactatattgttcctcttgtcttgaattcatggcctcaagtgattcttcgacctctggaagtgttgagattacaggcacgagccaccacacccacccaacatggtatatcattgttttaaatttgcatttctttaattagggtgtttttatatgtgtataaactgtttttattttaatttttttccctgaaaatggcctttaatgtattttgccacttactattgggctgttgacttttttttttgaaaccagtcctccctctgtcacccaggctggagtgcagtggcatcatcttggttcactgtaacttctgcctctcaggtccaagcaatcctcccacctcagcctcccgaataactggaactacagggatgcaccaccacacccagctgattttttaattttttttgtagagatgggattttgccatgttgcccaggctggttttgaactcctgggcccaagccatctgcccacctcagcttcccaaagggctgggattacaggcttgagccactgcacccagcctgttgatcatgttcattaatctgtttgaactccatatattaaggaaattagtcctttgtcaaatatgttgcaaatattccctccgatttgtcacttactttcattttgttggtggtttttctgttttgttgttgtttttctgtgggttttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactgatttgaaatgccatttttaatgtattccctaacatatttgggtctgtttctggatcctctaacccactgttctagagagaaaggtgatcgttttagattatttgtctctctgtaatctaaaatccaaggtacacgctgggcacagtggctcacacgtgtaatcctagcactttcggaggctgaggcaggtggaacagttgaggacagaagttcgagaccagcctgaccaacatggcgaaactctgtttctactaaaaatacaaaaattagctgggcatggtgacacgtgcctgtagtcccagctactcgggaggctgaggcaagagaatcgcttgaacccgggaggtggaggttgcagtgagccgagattgcgccactgcactccatcccccgggcgacagagtgagactccatctca

SEQ ID NO: 381868 - DNA, 3599 bp, Homo sapiens
  misc_feature (2190)..(2190): n is a, c, g, or t
  misc_feature (2462)..(2462): n is a, c, g, or t
ggtctagatgtgtgctgtccagcatggagccgggagccacatggagctgttgagcacctgaaatatgactagttcaaattgaggtgctttgtaaatatgaaatatgctgaatttttaagtttttttcttttctttttttttttgagataggatcttggtctgccacctgggttggagtcagtggcatgatcctagctcactgcagccttggacacctgggttcaagcgatcctcctccctcagactcacaggtagctgggactacaggtgcatgccaccatgtccagctaatttttaaatttacttgtagagacgaggtctcaccatattgcccagggtggtctcaaacccctggcctcaagcgatccttgtgcctcagcctcccaaagtgttgggattacagacgtgagctacaacacccagcaggttttggagatttagtacaaaaaaagaacgtaaaatgtctgattataattttttaaatactgattaaatgttgaaataatatttggatttattgggttaaattcaatatatttaaattttatgttttaattttttcatgtagctactagaaaatttaaaattacatttgtgggtcgcactctttttgttgggcagcactggtctagatcaggagttggtaaactatggcctatgggccatatccatattgctgcctgtttggggatggcctgagagtaagggtgatttttatagatgaacatttacaattgattcagtcaaatggaacactaactttgaatcccagttaagtgaaatgttttctcaacccccaaaattccattattttcattagtagtacaaaacaattgtactcagttatattttgaatttgtcaaaaatgttatggaaaaatgtttttctttaattatgcaagtagctacagaatatttttgactttgccacttggcctgcaaagcctaaaatttttacactccgcccttttacagaaaaaaaattgccaacttctggtttacaccctacaaatttaaccaagagatacctttggatcgcccctgggctctctctatccctgaggaggtaaaatattatctcactccactctcagctatctgttcaaagatcagaatcctatgagaggggacagtccaaagatagaatctgaaaaacaaaagtaaacgttaaagaaatggagaatgggaacttacctggttggcactgtagttagtggccatgatcttgtgctgtttacactcgttgcttggcaactgcagaaggccgacctcctgggactaccaatgagcagaggctgcctttctcttctgcttattattattcacttccttggctcacactgcccccatttgttttctctggaacttagattcatttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgngaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccaacatggagaaaccctgtctctactaaaaatacaaaaaattagccaggcatggtggtgcatgcctctantcccagctactcgggaggctgaggcaggagaattgcttgaacccgggaggctggagtgcagtggcatcatcttggttcactgtaacttctgcctctcaggtccaagcaatcctcccacctcagcctcccgaataactggaactacagggatgcaccaccacacccagctgattttttaattttttttgtagagatgggattttgccatgttgcccaggctggttttgaactcctgggcccaagccatctgcccacctcagcttcccaaagggctgggattacaggcttgagccactgcacccagcctgttgatcatgttcattaatctgtttgaactccatatattaaggaaattagtcctttgtcaaatatgttgcaaatattccctccgatttgtcacttactttcattttgttggtggtttttctgttttgttgttgtttttctgtgggttttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactgatttgaaatgccatttttaatgtattccctaacatatttgggtctgtttctggatcctctaacccactgttctagagagaaaggtgatcgttttagattatttgtctctctgtaatctaaaatccaaggtacacgctgggcacagtggctcacacgtgtaatcctagcactttcggaggctgaggcaggtggaacagttgaggacagaagttcgagaccagcctgaccaacatggcgaaactctgtttctactaaaaatacaaaaattagctgggcatggtgacacgtgcctgtagtcccagctactcgggaggctgaggcaagagaatcgcttgaacccgggaggtggaggttgcagtgagccgagattgcgccactgcactccatcccccgggcgacagagtgagactccatctca

SEQ ID NO: 381869 - DNA, 2709 bp, Homo sapiens
  misc_feature (1300)..(1300): n is a, c, g, or t
  misc_feature (1572)..(1572): n is a, c, g, or t
ccgcctccgacaggacgcgcctggcgaaaacgctacacgcttacaagaactatggacgacatgggcaacttacctggtcggcactgtagctcagtggccatgatctatgtgactgtttacactcgttgcttggcaactgcagacggccgacctcctgggactaccaatgcagcacgaggctgcctttctctactgctatattattattcacattctttgaacagatagctgagaggggacagtccaaagatagaatctgaaaaacaaaagtaaacgttaaagaaatggagaatgggaacttacctggttggcactgtagttagtggccatgatcttgtgctgtttacactcgttgcttggcaactgcagaaggccgacctcctgggactaccaatgagcagaggctgcctttctcttctgcttattattattcacttccttggctcacactgcccccatttgttttctctggaacttagattcatttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgngaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccaacatggagaaaccctgtctctactaaaaatacaaaaaattagccaggcatggtggtgcatgcctctantcccagctactcgggaggctgaggcaggagaattgcttgaacccgggaggctggagtgcagtggcatcatcttggttcactgtaacttctgcctctcaggtccaagcaatcctcccacctcagcctcccgaataactggaactacagggatgcaccaccacacccagctgattttttaattttttttgtagagatgggattttgccatgttgcccaggctggttttgaactcctgggcccaagccatctgcccacctcagcttcccaaagggctgggattacaggcttgagccactgcacccagcctgttgatcatgttcattaatctgtttgaactccatatattaaggaaattagtcctttgtcaaatatgttgcaaatattccctccgatttgtcacttactttcattttgttggtggtttttctgttttgttgttgtttttctgtgggttttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactgatttgaaatgccatttttaatgtattccctaacatatttgggtctgtttctggatcctctaacccactgttctagagagaaaggtgatcgttttagattatttgtctctctgtaatctaaaatccaaggtacacgctgggcacagtggctcacacgtgtaatcctagcactttcggaggctgaggcaggtggaacagttgaggacagaagttcgagaccagcctgaccaacatggcgaaactctgtttctactaaaaatacaaaaattagctgggcatggtgacacgtgcctgtagtcccagctactcgggaggctgaggcaagagaatcgcttgaacccgggaggtggaggttgcagtgagccgagattgcgccactgcactccatcccccgggcgacagagtgagactccatctca

SEQ ID NO: 381870 - DNA, 728 bp, Homo sapiens
gacaaaaattattttatattactatttcatcatagaagcaatatatacatactcccagaagtatttgaaccagaagataatggactgttggccagtagagcagatctgggcacgggacccacagcatccagtacattaatcctttacagttccttccatgtgaattgtctgagtgtgctctttgtccattcctccttttgttaattaatttttaacaattcaacagttattgtctactatatgttagagctcttgaatctttctaagcgctgtccttcaatgaaacacagggatttatttgccagttccttatattaaagagaggatctccttatagtagctgctatataatagtctcttgtctgctttatttttaatataatactttctcagtttcctgttctccttgtaagtaagtatcatggttttggcctggacagggtgaaaattctcatactgtagaaattatcagtggacttttgtctatacttcttccatttgctttgtatatagtaagaccagccaaggatataaattctcatatccaaatttttcatctaatattttaatatttaactttttaatccaacaggattttatgttgaattttttgtgataagagagatttaaaggaatgtactttcctcagaaaacaagacaaattctacagtggtgtctattaaatatttcctacctattcatgtgtgactctttactctatatcccaa

SEQ ID NO: 381871 - DNA, 191 bp, Homo sapiens
acctcacacagagtgggaaccatgggtctctgggcttggagaaagaatactttttgatgtggccttagccccatgtccatgagcccagcggtcgttcagccaccagactcagcttttcctcactgaataaaggggtcatttttccctggctgccgaaccagaattgccttgacttgcactgaacttcagct

SEQ ID NO: 381872 - DNA, 461 bp, Homo sapiens
agtccttgtgaggctgtttccttaccctttgatgaggtgtagtcacagcttcagaggctccccgcaaagtttttgtcatcagtgatggaacacaagatgtaagagctgaagagttatgaacacaaatgtgaaaccttgcctactggagctgccactagaaagcccgccaacatggcattgggacgaatataatcaaagtctcccacccctaaacagagaaaaacaaaatatagcatatggccaaagtgatttatctttatactttttttaatctttaaaagatatttattgccctataatatacctacagaaaaatgcactgaccctcagtgtacatgagattctttcataaatttcatgtgtacatgcgtacttcaagtgtacgtgaaatgacctctgtttatattccatcacaatgcctggacaagacttacttaatataagtgaaaaaatcactttct

SEQ ID NO: 381873 - DNA, 325 bp, Homo sapiens
attaatttgatgttgcattcaaattaaactcatttgtgtttcctattggggactcttcagagggataaaaatgcttcctactaggagcagtagccatgttaacaggaggttgagcatatatagtctcaggtgatattacaaggagtgatagacagctgggtgggtgaacatgggctatctctccattgaattgtctcctttagtgtcccttaagaagagtttttaatctcctgcatatagatcttaagcatcttttatcagatttatacctagggcctaggtaattgatgctttttttttttaactaatttaaatgtcttttgta

SEQ ID NO: 381874 - DNA, 315 bp, Homo sapiens
catctacataagatgtagtatggactgatgccaagtgagcctggggtggaaatcagaactggatgcaaatcctgatgttatccgagaacaggcacctgttacataggctgtgttactgtggcaaaggtaatggtaaaacacagactggccagaagcattgtgtacaatgagaccttgcaactttgtgtatattagtatgtggggggatgtgaattattaaagacatttaaaactgactgaatcagcaacctctaatctataaaaaaaaattccagacgtccagccgggcacgttctcgtgcctataatcttagtg

SEQ ID NO: 381875 - DNA, 335 bp, Homo sapiens
aaggtcagcaaaagatgagaggaccatttgtgctactgtgccttgtccaaactcttctctgtggtcagtcacctgcaaggccttaattgagtcaggcactatagaatatgcaaaaacgaagagatagattctgatctcaagagtcttgcaatatagctgagaaggaagaaggtaacacacccactgaagactgaagaattggatataatagtggaaagatgtactcaatggtgagtaatcaattcttttgttgttgttgttgttgttgttgttgttgttgtttttgagacggagctcggctctgtcgcccaggctggagtgcagtggtacgatct

SEQ ID NO: 381876 - DNA, 616 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381877 - DNA, 548 bp, Homo sapiens
cggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatacaccaaaccttctagctgctaatactcagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381878 - DNA, 458 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaatgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381879 - DNA, 787 bp, Homo sapiens
cggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatacaccaaaccttctagctgctaatactcagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaccgcggagggcttctagtgggggggggggggaagggggtaaggaaaggggccaggggcaaaggggggcccgggacccagcttccggggccaagggggaaatcgggggccccctatgggaggcgataaatccgaaagccggttacccggttagatcggggaaactggaccccgggaaaccccaaccccgaccaaaggaaacgggccaacgacggaagcagcgaca

SEQ ID NO: 381880 - DNA, 690 bp, Homo sapiens
cgggttaggatttcacgattccaatccaaccatcacactattaattccccaataaaccattgaaaaaaggcctatcagtgctaccacattgacatataaagtttccacgtattaggtaatagaagcctatgtaccaatttctaaaacagttataagatatatcacaatttggggtatattaccaaaccagaatattacaaaatattaaaggcaatcctcctggtccacggacccttgttgccgcttacttgaagttggcataatctgagaatgcatcaatatactcctgcacccgagttgaaaaatgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381881 - DNA, 705 bp, Homo sapiens
gcacatactattgtggatgttgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaagcggcagcataaactattcaacttttgcaacataggcataacatttcacaaaatatcaataagatatgcacctaatgataatctgtttatcatcaaatggttttgtggcctaagagtcacctgacttgcataaataaagtacttttctggacgaaacattgggaacctcacaaaaggaaagaaggcagcagcaactaacatgacacaggcttcaagcaaaaattaaaaaaaaaaaaaaagtcacttttgcaaaatgtgtcccagcttctccccatagggcactatcagtagagattggaaataagaaccttgtacctttaaatatgtaagtagcaaagagaaaaaacccgaaacaaaccctggtttcactgaacataagttagtcacctaatagagaaacttaatcacaaaatgttggccaggaggcatggggataccagtgctgtttcagcac

SEQ ID NO: 381882 - DNA, 1611 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagaaaatgtttacaacaaaagaacaagagggatcaaactaacaatcaataaggagaactgatgtgaagtcccatacactgttactccatttttcagcaactctttataactccttcattgacttgactcctttacaacatacagctgaattgtagaactagttcttcaagtgtggttcctatagtagaacagcagcatcactggggaacttaataaaatgcatcttcttatatcccataacaaacttattgaataaacagggtggagcctagcgatgttttaacaagcccttaaggtaactgatgcatgctcaactcagagagccactggagcagagctggctttcattcagcccctgcatcatttttaccagtctcttctattaaaaaaaaaggtctggagcagtaagctctgacagtgttttttcttccaataaaactcttaatactatagttgcataaaactacctaatgcgcccagagtagcaggttctgctaggatttttctcccagtaaaaaagcactcaacactgtagttgcattaaaactacttgatgtccttggtgtattgataacctgttttgcttttgccaaagcaatttcagatgccctactggaaaatttatccagagtaggtttgatgtaataccagcaacatttttaattttttttttttccttttgagacacagtctcactcttgcccaggctggagtgcagtggtgcgatctctgctcactgcaacctccatctccagggttcaagcgattctcgcgcctcagcctcccaagtagctgggattactggcacacgccaccatgcctggctaatttttgtatttttagtaaagacagggtttcaccatgttggccaggctggtctcaaactcccgacctcaaga

SEQ ID NO: 381883 - DNA, 1123 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381884 - DNA, 1004 bp, Homo sapiens
  misc_feature (28)..(28): n is a, c, g, or t
  misc_feature (40)..(40): n is a, c, g, or t
catctttccaaccactgaccgggttaangaagttaccaancatgagtgagtttcttctaaaacactaattttcaaaacttgtaagaatagtaactttgatctagtctgactttcccaagtacatctacattccaaatatagtacaacagaagcaaaagacaagaagtaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381885 - DNA, 1446 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaaggattccttctgtccatcatctttcaacactgaacagataaagaagttacaaacatgagtgagtttcttctaaaacactaattttcaaaacttgtaagaatagtaactttgatctagcctgactttcccaggtctctacgtccactctttgcccggagcgcggcacactccgggggggggcg

SEQ ID NO: 381886 - DNA, 1483 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381887 - DNA, 841 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381888 - DNA, 1577 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaagcggcagcataaactattcaacttttgcaacataggcataacatttcacaaaatatcaataagatatgcacctaatgataatctgtttatcatcaaatggttttgtggcctaagagtcacctgacttgcataaataaagtacttttctggacgaaacattgggaacctcacaaaaggaaagaaggcagcagcaactaacatgacacaggcttcaagcaaaaattaaaaaaaaaaaaaaagtcacttttgcaaaatgtgtcccagcttctccccatagggcactatcagtagagattggaaataagaaccttgtacctttaaatatgtaagtagcaaagagaaaaaacccgaaacaaaccctggtttcactgaacataagttagtcacctaatagagaaacttaatcacaaaatgttggccaggaggcatggggataccagtgctgtttcagcac

SEQ ID NO: 381889 - DNA, 1348 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381890 - DNA, 1132 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacaggacatagtatcatcatgttagaagccttggaacgagtataaataatggctgttcagcagagaaaccatgtgcattatccatagggctgttttcactaatgatggtaaaaaattagcgtcatggtacatcttcatattagaaatgtagttaaattaacttttggatagtcaaaaaggtttttcagatggttggaattaatatcaggctaatacaagattatacatgaaattcatggtgaaatgattcacaggagtaaggcgataaacgtgaaaaccaccaaaacagcacaccggcacgagcaaacaaaaaacaaagacaagaaccagaaaagagaaacaagaaaaagaaagaaaacgagagcaagagaacaagaagacagagagggcagaaagacgaagcacaagagacacaaagagacaacgaagaaagaggaaaacagaagaaagaagaaaaagagaaaaaagaagaaataactgacagacactcacccacgcacaacgcccaggcaacaaaca

SEQ ID NO: 381891 - DNA, 1880 bp, Homo sapiens
  misc_feature (95)..(95): n is a, c, g, or t
  misc_feature (1443)..(1443): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatgatactatttcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacactacaccccttatccccatactagttatcatcgaaaccatcagctactcattcagacaatagccctggcggtacnccttaacggtaacattactgccaggcaactactcatggaccctatggaagcgccacctaaggcatttaaccattaacttgcctctacagtatcattcttcacaatcaatacacgcgaatccagaaaacgcgggccctaatcacaggcctgctttcaacccttcagaaggcgccacacggccgactacgcacttacaacacaaccaaacaaagacaaacacgagaaacacacaacaacagacaccccatccgccacgggccaccccaaccaaactccccccacacggacacaccgggggccgccagcgaacaacaaccgcacacacggacgccgcccacacagcgcgagcgacccacaccaaacccggcggccgccaccacgcatcgcctcgcgccgagctcgtcccccaccagtcgacacagacgcagcgcaaccac

SEQ ID NO: 381892 - DNA, 1459 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaagtaaagatacaagagttctcttggagatttcatttttcttttggaatgtgtattaactttcctggttagtaacccccagaaatggcaaataacaggcaagattagactttccatctcctttttagttgcatacggcagttactcagctgtagtaatatcctggttacctgtaggtaagatctcaactatacagaacctaaggtcctagcgcttgaaatagctgttggaaatcctttttgagctttattctgcaatagaggctcatagttggtccttcattagagcagtagttctgaaaccttaatgtgtatatgaatccccagggaatcttcttaaaatgaagattctacttcagtaggtatggggcagaacttaactaaggttttgcatttctactaatgcctaatgcagatctgccagttcacaggtaacactttctgattttacttgtatacatagttaacctggattttctggtttaccacacccaaaattttaaggtagccaaggt

SEQ ID NO: 381893 - DNA, 706 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381894 - DNA, 1472 bp, Homo sapiens
  misc_feature (28)..(28): n is a, c, g, or t
  misc_feature (40)..(40): n is a, c, g, or t
catctttccaaccactgaccgggttaangaagttaccaancatgagtgagtttcttctaaaacactaattttcaaaacttgtaagaatagtaactttgatctagtctgactttcccaagtacatctacattccaaatatagtacaacagaagcaaaagacaagaagtaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagaaaatgtttacaacaaaagaacaagagggatcaaactaacaatcaataaggagaactgatgtgaagtcccatacactgttactccatttttcagcaactctttataactccttcattgacttgactcctttacaacatacagctgaattgtagaactagttcttcaagtgtggttcctatagtagaacagcagcatcactggggaacttaataaaatgcatcttcttatatcccataacaaacttattgaataaacagggtggagcctagcgatgttttaacaagcccttaaggtaactgatgcatgctcaactcagagagccactggagcagagctggctttcattcagcccctgcatcatttttaccagtctcttctattaaaaaaaaaggtctggagcagtaagctctgacagtgttttttcttccaataaaactcttaatactatagttgcataaaactacctaatgcgcccagagtagcaggttctgctaggatttttctcccagtaaaaaagcactcaacactgtagttgcattaaaactacttgatgtccttggtgtattgataacctgttttgcttttgccaaagcaatttcagatgccctactggaaaatttatccagagtaggtttgatgtaataccagcaacatttttaattttttttttttccttttgagacacagtctcactcttgcccaggctggagtgcagtggtgcgatctctgctcactgcaacctccatctccagggttcaagcgattctcgcgcctcagcctcccaagtagctgggattactggcacacgccaccatgcctggctaatttttgtatttttagtaaagacagggtttcaccatgttggccaggctggtctcaaactcccgacctcaaga

SEQ ID NO: 381895 - DNA, 1270 bp, Homo sapiens
cggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatagtatcatgttctagatagacggctagagggggaaattctctgaaggaactaaggaggggctggaagggaaggaagtgtttttaaaactacgtgaggcatcagaatccgaaagccactttagtcttagcaaatgtgtttgtaggtgtttgagcttttacttagaaacctcattcctttttcttgccttcttttacgttaagcttgaatgtcatgtgttatcttgctctgatgttgaaactatataagaacattcatttttctttttttttaagaacattaattttttctagtcagagaaggctaattttttgaagttttttctacacacccagtaaagtcaaacaactttaagtaggagagccttactttaggtaggactcaacgtaaagctttgaattcctcaaatactttttgagtggacttaacaggttatgtgtttcctgactacgtttctgttttgcttatacttcctgatgctggaattctacatgtattagttggattgcacaaaggatgcaaaatttttacagggatcagttttttctggcgtagcatgtggttggctttgtgtatagttagttcatttattaccaggcccatggaagtcagacaaaagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381896 - DNA, 1135 bp, Homo sapiens
cggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatagtatcatgttctagatagacggctagagggggaaattctctgaaggaactaaggaggggctggaagggaaggaagtgtttttaaaactacgtgaggcatcagaatccgaaagccactttagtcttagcaaatgtgtttgtaggtgtttgagcttttacttagaaacctcattcctttttcttgccttcttttacgttaagcttgaatgtcatgtgttatcttgctctgatgttgaaactatataagaacattcatttttctttttttttaagaacattaattttttctagtcagagaaggctaattttttgaagttttttctacacacccagtaaagtcaaacaactttaagtaggagagccttactttaggtaggactcaacgtaaagctttgaattcctcaaatactttttgagtggacttaacaggttatgtgtttcctgactacgtttctgttttgcttatacttcctgatgctggaattctacatgtattagttggattgcacaaaggatgcaaaatttttacagggatcagttttttctggcgtagcatgtggttggctttgtgtatagttagttcatttattaccaggcccatggaagtcagacaaaagatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381897 - DNA, 657 bp, Homo sapiens
cggccaggctcccgcgcatgagacgtgaagcccgcgcagagctcgcgcgtcggtgtggttacagccggcagccacggcacctccttccggccgactagtctccaggtcccgcggtctggcccctggtcacccggcgctgtccctcgttccttgaagatctccagtgctaccttttgttgaacatctcgaatagtatcatgttctagatagacggctagagggggaaattctctgaaggaactaaggaggggctggaagggaaggaagtgtttttaaaactacgtgaggcatcagaatccgaaagccactttagtcttagcaaatgtgtttatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381898 - DNA, 593 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaatgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381899 - DNA, 477 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaaaccccaatttggggtttttccccccccccttttttcccccctttttttccccttttttttccccccccccaaaaattccgggcctgttttactatgatgta

SEQ ID NO: 381900 - DNA, 653 bp, Homo sapiens
tgcttgaacctgggtggcagaggctgcagtgagccgagattgcgccactacactctagcctgggcaacagagtgagactgtctcaaaaaaaaaggtgaaattagtcattggagacttggcattagaatctcataaagcaaattgttagccttaaatccaaaagatgtctgtcgtataaagggcttagagttgtttggtgtccctgtggcttgaacaaagctttgcaaaccgacatgtaatattaaaaaaccattaatgatttggtgaaaattcttaaatcatcatagttatgtctgttacctgagttgttcttttcaaatttatttttctctttcttaggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381901 - DNA, 481 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaa

SEQ ID NO: 381902 - DNA, 1640 bp, Homo sapiens
  misc_feature (95)..(95): n is a, c, g, or t
  misc_feature (1606)..(1606): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagaaaatgtttacaacaaaagaacaagagggatcaaactaacaatcaataaggagaactgatgtgaagtcccatacactgttactccatttttcagcaactctttataactccttcattgacttgactcctttacaacatacagctgaattgtagaactagttcttcaagtgtggttcctatagtagaacagcagcatcactggggaacttaataaaatgcatcttcttatatcccataacaaacttattgaataaacagggtggagcctagcgatgttttaacaagcccttaaggtaactgatgcatgctcaactcagagagccactggagcagagctggctttcattcagcccctgcatcatttttaccagtctcttctattaaaaaaaaaggtctggagcagtaagctctgacagtgttttttcttccaataaaactcttaatactatagttgcataaaactacctaatgcgcccagagtagcaggttctgctaggatttttctcccagtaaaaaagcactcaacactgtagttgcattaaaactacttgatgtccttggtgtattgataacctgttttgcttttgccaaagcaatttcagatgccctactggaaaatttatccagagtaggtttgatgtaataccagcaacatttttaattttttttttttccttttgagacacagtctcactcttgcccaggctggagtgcagtggtgcgatctctgctcactgcattccagcctgggcgacagagtgagactccatctcaaaaaacacaaacaaatacaaaaactaaggaagccttaataaagtacagccttaagttaataataatgtattggccgggcacagtggcagagcaagactccgtctcggaaaaaaaaagnaatatcgtatcttagtaatgtgacaatctactct

SEQ ID NO: 381903 - DNA, 1650 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagaaaatgtttacaacaaaagaacaagagggatcaaactaacaatcaataaggagaactgatgtgaagtcccatacactgttactccatttttcagcaactctttataactccttcattgacttgactcctttacaacatacagctgaattgtagaactagttcttcaagtgtggttcctatagtagaacagcagcatcactggggaacttaataaaatgcatcttcttatatcccataacaaacttattgaataaacagggtggagcctagcgatgttttaacaagcccttaaggtaactgatgcatgctcaactcagagagccactggagcagagctggctttcattcagcccctgcatcatttttaccagtctcttctattaaaaaaaaaggtctggagcagtaagctctgacagtgttttttcttccaataaaactcttaatactatagttgcataaaactacctaatgcgcccagagtagcaggttctgctaggatttttctcccagtaaaaaagcactcaacactgtagttgcattaaaactacttgatgtccttggtgtattgataacctgttttgcttttgccaaagcaatttcagatgccctactggaaaatttatccagagtaggtttgatgtaataccagcaacatttttaattttttttttttccttttgagacacagtctcactcttgcccaggctggagtgcagtggtgcgatctctgctcactgcaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381904 - DNA, 1258 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381905 - DNA, 804 bp, Homo sapiens
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaaggattccttctgtccatcatctttcaacactgaacagataaagaagttacaaacatgagtgagtttcttctaaaacactaattttcaaaacttgtaagaatagtaactttgatctagcctgactttcccaggtctctacgtccactctttgcccggagcgcggcacactccgggggggggcg

SEQ ID NO: 381906 - DNA, 1235 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaatgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaaca

SEQ ID NO: 381907 - DNA, 1362 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaccgcggagggcttctagtgggggggggggggaagggggtaaggaaaggggccaggggcaaaggggggcccgggacccagcttccggggccaagggggaaatcgggggccccctatgggaggcgataaatccgaaagccggttacccggttagatcggggaaactggaccccgggaaaccccaaccccgaccaaaggaaacgggccaacgacggaagcagcgaca

SEQ ID NO: 381908 - DNA, 1320 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaaaaaaaaaaaaaaaaaaaaaaaaaaaaaaaaaaaaaaaaaaaaaaaaataatttaaaaattggggcccgcttggcccaagtgatttttagattggggaaggtttttacttgcggccgaatttgggccatattgggccatttgcccttatggggggtggattaaaatcaatgggccgggttat

SEQ ID NO: 381909 - DNA, 1866 bp, Homo sapiens
  misc_feature (95)..(95): n is a, c, g, or t
gcgtggtttgtgttggtggggttcgccgggggtattatgttgtggctcgtgtgggccggatggctccgaccctcgggttgttcagggcgcggtgncccgggttttttatggtgggggacgcggcacagtgtcaggagcccggtttctctggcgccgcttggggcgcgaggtcgaggttgcctactggtgccgcgggccccaaccgggtggcgttttggaagatttctttctccggggctggaggcgcgcccacaaatgttttttttttttttttttgtttttttttaatgatgtagttgtttattttgaatataatcatgaagtggggaaaaattttaatacaagagtagaaagaggattccagagaaaaacattccagtgtatcatggttctttgtgagtgagtagagaggggtagtgaggatgctgtccacaatgtattcatctagttaatgaattgtatggcccacaagctcaaacgagagatacattacagatggttgtattataaacctaatcttaagaaaccttaccaagcaaatgcttaaagactgatttttttgtgatctgataaaaagcctgcaaatcgtgaatcacttttaaactgtacagaatggactacacaccagtatggtaaagttcttgtaaaacaccaaacacaatggctcatagatatatacctctctcactcttaaatggcatttcctaattatagcggacgcgtgggtcgacccacgcgtccggtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataaatggctgtttcagcagagaaacccatgtcctctctcccatagggcctgttttcactcatgcatcgtcaacacattcaggtcatgttacatttctacatcattcagcaacttttgtgttcaacacaatcaaaccttttctgtcaatcagtctacaaaataacaaacacaaaaacacatacctcgagagcgccatctcttatttgttcgggggggcgggaaaacaagcggaggtaattgcacagtgggcacccatgggtcatatacgctgtctcccatagcgacccacaggcttcctgggtaccaaaggggggtaagactcatcgccgggcaccaccactaaaataggtggaggaacgcacatacaaaataccagaaacagcccccggggataaaccctggcgcttaacttgacattcgcggcaaaccgacacaaacacaacactacagacaacacagaacagactaccagagacaagcaccacacaaagaaccaacaacaagaacaccaacgagaaagcacacagagagaaggtaggagagggcaacagagcgcacaaatggccatgatcgcgacaacacgaccagaaggtggcgctcagtctgtgctagctgaacgcaggatgctctaaacacgcgcgccacacacagctacaaacaagaaatccaagccaaggcgagctgaacgtgcgcaactaagaggaccagagaggagagcgcacagagaagacgccaaagaggggaagacagaaggagcaccacagcacagcggacagcgttaggacgagaaacgaagaaggacagagcgagaacaagtaagcagggacacagacgcacgcagtccagacaagcgctccacagccaggcatc

SEQ ID NO: 381910 - DNA, 651 bp, Homo sapiens
  misc_feature (512)..(515): n is a, c, g, or t
  misc_feature (517)..(519): n is a, c, g, or t
  misc_feature (522)..(522): n is a, c, g, or t
  misc_feature (526)..(526): n is a, c, g, or t
  misc_feature (546)..(546): n is a, c, g, or t
  misc_feature (559)..(559): n is a, c, g, or t
  misc_feature (561)..(561): n is a, c, g, or t
  misc_feature (567)..(567): n is a, c, g, or t
  misc_feature (571)..(571): n is a, c, g, or t
  misc_feature (574)..(574): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (598)..(599): n is a, c, g, or t
  misc_feature (621)..(621): n is a, c, g, or t
  misc_feature (646)..(646): n is a, c, g, or t
caacaatccattggctaacgaggtcgataacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaaaaaaaaaaaaaaaaaaaaaaaaaaaacannnnannncanccantttaaactcacttcactttntccactctccccnanttatcntcanttnttcttccnccncacttntctcccnntccaccccccctttttcacccnttttttttcccccactttcccccantttcc

SEQ ID NO: 381911 - DNA, 342 bp, Homo sapiens
ccagtttaattgtgagatggataaattatttctggtagttgatattatatatgtatatgtacacaaatatatctctctactccacttttatttgaaaaaagcagcttaatgagtgtaagagaaccttgagctgcttttcacatggatattgtcactatagcatagaaacagatgcctctatcatatattggtctaattacttcctaatttaaacacgtatttttttaaatagcatgtttattttcaaatattatataattgtctgcatccttaaataattttaaacaatgtgtcccctgactgcatataatgttcaaaagtgtgaggtaaggactttccttt

SEQ ID NO: 381912 - DNA, 267 bp, Homo sapiens
tccacatagcactttccgtttaatctctgttcaatagttgaatcttgttagtggagtgagggttttgtgatgcagattaaccaccacttatcacaagggttctgaagttgctgtattcagaagcaaaagttagtaccacatgctgggcacagtggctcaggcctgtaatcccaacactttgggaggctgaggtgggcagatcacttgagatcaggagttcaagaccagcccgaccaacatggtgaaacctcagctctactaaaaata

SEQ ID NO: 381913 - DNA, 436 bp, Homo sapiens
attgttttgtaaaagtaatttcaattttaatcactgaactaaagaaatgggcaaggctgacttccgtaatataggttctacctaaccatctctaacaccgctgtcaaggaggaccagtgttaaggtacattactaacaaccacacaaatttttaaaagaaaagaacactcttagcagcctatggtactttgaaatgaaatattgcctctcattctcacttgtgttgccattccaaaagtatgaatttgctgaggtttatattctgggtattatataaccattggttctgtttggcataaccctattaaatggtgctcagagctgaattacctacagaaactttctggtttaattagcataaattggtataaatattagtgagcccatacttctgtgatataattaaaccaacttaatgattctcacataaggtgtc

SEQ ID NO: 381914 - DNA, 3184 bp, Homo sapiens
gaagtggggatcggcgagcgggtgggtgcgcctcgggccgcgggactcgcagccgccaccgccgctgccgcctctacggccgcgtcagaactgaagagaggaaggggaggagccgagtcgagcctaagctgccgcccgatcttacccctgacccgagggcggcctggagagcttggtctgtagcggtttccttcggggcaggtggggactgctcctttgggaggaaggaggaggcccaggccgcgtcttcaggcagctgcgcgcaccacccgaaggtgaggcatttggccccaaacagaccctcgaaaagccggactgatcgaggagttaccctacagcctgatctgcacctgctccagggagagagcgccccacccttcccgtggcgtggggtgagacccagcgttggataacgtgtggtcgggccgagcaaatgtttgatgaatgaatgaatgaatgaatgcctctctcacgtggcactcgtgaagctcagaggatatggtggaagtgcaagcgctttgtaaactgcagtgcattgtaacaaactgagttgtaatacattcctcccctccccctagccatgaaaggaaacaggggtgcggcttgagtacagagtcacaacctgagtctttagtggaaaaggagacgaaatgccgagcacgggaagggacccatcctcgcgcagattgttagggcggcgggaagggaggattggaagggagccatcctctgggagattgctgaaggatttttgactgtcaggggaagaatttaatagtccctcacttttacgaatggttctttcttacggtttggagctttcgagagcttctggtcttggttcatcagtgtacgttgtcatcaagaaatgttggcctgtttcaggtctgactcaaaggttattttctttctaaaataagtgttattactattatgcagcttttcctacagatgttatcctggaaaggaaagttaagtagaaactcatgaagtttaaagtgtagttctctaggaaaacaaatttaagataaaaggaccagaatcctcagaaatctgtcttcagtgaatagtatgagaaaaagattaaagcagcagcaatgatgaaagcagattccacaattctgtccctggaccctagtacactctacctccttgggaagcagtagtaatggattttacaagtctttccacctggaggagggggtaaggtaggagcaagtgtattatagacaaatgtgggaagctctgggtttctcccactactgccactaccatctgcaaacagtaaactaaggaaacttttaactgggtaaatccaagggctcgtgttcattaaaatgctgcgggaaaggtggtgagaggggcaaaggaggatgtggcaaaaccaaggagagactcacagactagcacctgaccctactgcccttgacctgaagttccaagagccaggttaaatatcctgcttaaattaccctggatttttctgtctttacgtgaccaatcccctgctacagccttccaaataagactcacaggtaatcagaccaacaagtgatggtctcacatggctacaaaataaatattttttgtttttccccctcttcctatcttacaacaggggaatggtggaaattaaaggagtaaaacacacagatttaggggattttgtgaagctaaacacctcagagagtttaacctttgtaggctttgaaggaaaagagtgcaaacatcagagttctgcagcccagcagagaacacctccagttaagtgtgtaccacatagggtttttcagcagcgtgatcttctgttttcattgtcagtggctccaccttacaacctcagtgctgaggaacagaagggcactcaggagagcctgagccacttacttagaaagtatttaataacagcacactaagcttactgggctagatacccacctcagcacccagcttgataacaggaggaaacagctggaactggagactggagagaaggaagttcatacatttccaacttggtctgcatctctttagttccttgtattgcttattaatccagaggagaaaacagctagttaattaaaaattccaaaaaatctgaagttttagctaatagttacttccctggttcatcaatttaagataaggatctaaatactgtgttaaaatatagaaaaacggagactcttataaggtttttgacctctacacttgaaagtgagctcttacaagaaactaatcagtgtttcgttattccatatcagtggcttttactgtcaaagattgtgtaagctaaattatctggcaaaattttgctttccagaaatactatctatattaattttaacatttttattgtgaaatatagtttaaatacataaagcaattatatagtataagtgattataaaggaaaccaccatgtaaccaatcaaccaggtcaagaaatggaatatttccagcaactcagaagttcccctccctgccatgaccttcccgaacacaactctttccctccctcctaagtgtagtcattattctaacatttgtgataatcatttccctgcttttctttgtcgctttgtcgcaagcatgcatccctaaacaatatattgtttagtctcactctttcttttgaactttatgtaactggaacaatataatatgtaatctgttgttcttgctgcttttgctcaacattgtttttaattcatatgttgttcaggttgttcctatagctgtaatttgtgcattttcattgctgcatattacagtgtcccattataacaatatgtgacaatatgtttagccattctattgctgatggacatctgggttgtttccagtttaggattgttataaatgctaatgtgaacattcttcatatatgtattccatcacatctacgtcagtttctgtataacatatacctgggagtgtaatatgtatcataaacttgaataaataatgccaagttcttttctagagggttacacagtcacactaggtatatatgagtcccattgctccacaccttcacaacacttgacattattggtctttttggttttgccagtctggtgggtgtatggtaatatatcattgtggttttaactgtcatttctctgattactgatgctgttgaggaccttcttgtatacaactagctatttggatttacattt

SEQ ID NO: 381915 - DNA, 863 bp, Homo sapiens
ttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtccctgccctctccagccaggtgtggggtctacaggtatcactgccacagcctcatttcttatatttgtacaacctgactgtgaatttgcaacccatacactgcgtgaatctaaattctactgaggcagagaccatggctgttttaacttttattctagttaccagcttagcatatggtagtagtgatagtagtaactgtgatcatcatcactaaaactggagtgctcactacatgctattctctgttctaagcacattccatttacttacttagtcctcatatctactttatgaattaggtactgtctttctttgatggtaatgatccttttataaaattaaattagtgctaagagactttcagcaatgttatatattgcctgtccattaaagattgttgccaaatggagtgagttgtccccagtaaggattcactatcaatgcagaagaaatgcacggataatctactttgcataaagaatggggctaggttgcatctgcatggtatcccaaataaataaaatgtgccactacccttgcaccaaaattattttatgatgggtaaagttagacccttgagaggt

SEQ ID NO: 381916 - DNA, 429 bp, Homo sapiens
ttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtccctgccctctccagccaggtgtggggtctacaggtatcactgccacagcctcatttcttatattttggaccaaccctggacctgtggaatatttggcaaaccccaattacaaccttggcggtgtactttctataatattcttatcttgg

SEQ ID NO: 381917 - DNA, 1287 bp, Homo sapiens
ctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttg

SEQ ID NO: 381918 - DNA, 938 bp, Homo sapiens
gttctagagggtcccctccagtaatgtgtgaccagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttg

SEQ ID NO: 381919 - DNA, 879 bp, Homo sapiens
  misc_feature (1)..(1): n is a, c, g, or t
naccctgaatcggaggacaaccagtaagctacccttttaccatcattggacaagtagcatccgtactatacttcacaacaatcctaattctaataccaactatctccctaattgaaaacaaaatactcaaatgggcacacattatggagtaatgtgtgcccagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttg

SEQ ID NO: 381920 - DNA, 372 bp, Homo sapiens
gcgtcgacctgaaacaagttcatgtagcaacttgaagacattgatacttgacttgtatatgacccaaatacacagatttttcacatctgctctcagattgtcctaatttaattcaccatgatacatgattacgtgacatcatagacagtaactccaaaaagggaacgaagaaacagaatactctggaacttggtatgtttttagactcaaccctacataacatataacactatgaaagttacatttttgggctatgagtcaaatggccttgtctcgcacccagctgtgccctcgggttacgtagtcttccaggtttacaacattatattcacttctaaatgaataaattggattagaggatttttaagatat

SEQ ID NO: 381921 - DNA, 369 bp, Homo sapiens
gattcctgtatacccctcacccagattccccaaatgttggtattttgtcacatttctattgtcattttttttctttattgtatggatatttttcctgtaccatttgacagtaagttgcacacatgatacctcttcagtaggcatttctgaaagaacgacgacattctcttacataaccagaatatcattatccgtatcaggaaattaaaatccttacagcattattatctaatccatagatagtattcaaatgtcatcaccaatttttctaattacatccatataacagaagaaaaaacctttagtctggtcctggatgcagtccaagttcacacattgcacgtaattgtcttggctgtttagtttcct

SEQ ID NO: 381922 - DNA, 280 bp, Homo sapiens
atatgatttcaaacaattgtgaaaaaacaccactttttaggatctgttccctccccacaagctcactctgctaccccatttctactcccatcccctaccccttcaaccatagtagttcagcttttatatgctttttggtttactcttctgtgtgagatttgattagaaagaagagtgctcttggctaaaattagctctcaaatttctgccttagagcaagtcaggtatttatctctcaatccatattctgcttgactaaactatgaaggtaggtactttg

SEQ ID NO: 381923 - DNA, 116 bp, Homo sapiens
taaggtggaacaataatcctccccacctgaacagacctcaccacgcctcctgctgttttagcaaccccggggctccatcccagggctcctactgaatgtcccctgcctcttctcac

SEQ ID NO: 381924 - DNA, 456 bp, Homo sapiens
atgtaatgataccagatagtatataatagatgttgaataagtggtacagacagcaagtacagccagaattctgagtataaaaaaaaaagattcaaactctgaaactttttgagcactgacatgatgctcaaaagaaatgatcattggagcattttggatttcacattttttgattgggatgcttaacaggtaagtgtaataaaatattgcaaaatccaaaaaaatctcaaatctgaaatactcctgattaagcatttcagaaaactgatactcaacctgtattagaaataaaacatttattctatcttagagaaaactcatcatgtctaatcgtagatacagaaatttccagcaataactacttaagataactaagagattaggagagcatctataggaggacaaaccacaaaaacttagaactctttaatctggaaaaatccagactgcattggg

SEQ ID NO: 381925 - DNA, 404 bp, Homo sapiens
ctgccctctacgtaggcaactctctttaaggagtctctgaatcctaagagaacagaatgtttggaatgggtgtaatgaagatattgagtgactttctcctttctgcaggaccggatggtttccatggtcatggacagagagtatgatgtggcagtggaggctgtcagattactgatacttatccttaagtgagtcctgggaagaggggaggccagtgtctcagacctttgcccttccagggtcatctccctccacctgtcatagctgactcttccatctgtgcaggttgactgaggtcattcctgagttgcagtatgttgatttctgtcttctctaactccccatactcctttgtcttccgctcttcatttagaagttttttgtgagttatgtccttgttgctt

SEQ ID NO: 381926 - DNA, 5618 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381927 - DNA, 6047 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccaggggtgaggccatggagggaatctgggtgtctgagttcccagtttggtgtctggctgcctccatcttgctgtttctgtttcatggttccctgctgtagcactcccacattgttgggttcttctcaaacccttctccattgtttagctttaaaatgcatctctctgagcttttctccccattaacaccagctgccttacatcctcttcttacccttgatttttatcccatcattgatcctgcttcattcccagcagtcagcccgtcgcaggcaccgagaggtcaaggttcttgggtccacaatatttccagactccacacaacccttcaggtcctggcctgggcaaccagctgatgcggtgagcttttctcatcatctcctgtcttcacttcagatctgtcgcccactgtgaggggattcctgtctcacccattgcctctctgtgggtgctttttggacttgttttagccacagagcacttcctgtcagcacaatcgggaaactactatgctgtacttactgctccccacttcccccaccccgggtgtctgagaaactctcaggggtcctcaaagaacagtttgaaaagccagtctctttgcccctacatcagactcagccttatggaagaggacgaggaagaagagttagaaatccaggatgagtcaaatgaagaacggcaggatacagacatggtgagtagaccaccctgcccttctctctcaagaactaggggctgatgtgccaaagagaagccagggtgtttcccctctctccgctcggtgatgcctggtctggaaaagctgaatgaatctagagtaaaggaggacaggttatatgttggtttggactttgcttggactctacttttattaaagaataaggaaaagaaattacaaataccaaagaaggttggaatagcactctcgctcccaatccctaaataaatattgttgcctccgaaccccctaggaattggaaggagtcctaatgctggaggtgggaggtcattcagtccaagtggcagccccttcagtgtctctccccacaaaacatgaccccctatcctccatctccctactagagggcttcccctccctgtcccttccctcactccctttctaacctagcctgtttccccaggaggaactgctgctggtgtagtgggaaaagcctggcatttggagtgaggtgacatgagtgctagtcctcaactccatgtcaagttagcgcttttacccctcctcagcctccattttctcatctttattttttaattatttttattttttgaggtagag

SEQ ID NO: 381928 - DNA, 4280 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagccagcttgggcttcacgaagccactggtgatgccgaggttctcggctgctacagtctagccactgaccacaggatggtgaactctgatgacaacgtgtgggtgacaaagggcaggtcccgcttgagcaccaggatgaagtctgtctgatacgtggacagcatgaacacggatatgttctggtcagccagtggggcgatgactgacttggcgatcttggtcatgccaataggctgggagctgga

SEQ ID NO: 381929 - DNA, 5318 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381930 - DNA, 4789 bp, Homo sapiens
cccatccttttcatacatccttttgtaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381931 - DNA, 4115 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttgctcccttctcttttatttctgtagggccttggtgtaccttgttgtagtgtttgaaaacatctgagatggatgcag

SEQ ID NO: 381932 - DNA, 1103 bp, Homo sapiens
aacgataggctagtcgaggcgggtgttaatcggcaccgaggaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381933 - DNA, 651 bp, Homo sapiens
ccacgcctggctaatttttgtatttttagtagagacagggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381934 - DNA, 196 bp, Homo sapiens
ggggcgagtagagtgtggttagtcttatttccattctcctggttttccctcctcaccagcaccgagaagtccgcctgaagtgtgtgaaggccctgaaagggctgtacggtaaccgggacctgaccacacgcctggagctcttcaccagccgcttcaaggtaaaatgggtggtgctccatggcttggctctttgtcg

SEQ ID NO: 381935 - DNA, 4536 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381936 - DNA, 6125 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccaggggtgaggccatggagggaatctgggtgtctgagttcccagtttggtgtctggctgcctccatcttgctgtttctgtttcatggttccctgctgtagcactcccacattgttgggttcttctcaaacccttctccattgtttagctttaaaatgcatctctctgagcttttctccccattaacaccagctgccttacatcctcttcttacccttgatttttatcccatcattgatcctgcttcattcccagcagtcagcccgtcgcaggcaccgagaggtcaaggttcttgggtccacaatatttccagactccacacaacccttcaggtcctggcctgggcaaccagctgatgcggtgagcttttctcatcatctcctgtcttcacttcagatctgtcgcccactgtgaggggattcctgtctcacccattgcctctctgtgggtgctttttggacttgttttagccacagagcacttcctgtcagcacaatcgggaaactactatgctgtacttactgctccccacttcccccaccccgggtgtctgagaaactctcaggggtcctcaaagaacagtttgaaaagccagtctctttgcccctacatcagactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381937 - DNA, 6323 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccaggggtgaggccatggagggaatctgggtgtctgagttcccagtttggtgtctggctgcctccatcttgctgtttctgtttcatggttccctgctgtagcactcccacattgttgggttcttctcaaacccttctccattgtttagctttaaaatgcatctctctgagcttttctccccattaacaccagctgccttacatcctcttcttacccttgatttttatcccatcattgatcctgcttcattcccagcagtcagcccgtcgcaggcaccgagaggtcaaggttcttgggtccacaatatttccagactccacacaacccttcaggtcctggcctgggcaaccagctgatgcggtgagcttttctcatcatctcctgtcttcacttcagatctgtcgcccactgtgaggggattcctgtctcacccattgcctctctgtgggtgctttttggacttgttttagccacagagcacttcctgtcagcacaatcgggaaactactatgctgtacttactgctccccacttcccccaccccgggtgtctgagaaactctcaggggtcctcaaagaacagtttgaaaagccagtctctttgcccctacatcagactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggtgagtgtccccagagcaggagttatgtatccttgggaaatgctggcaggcaacccgtgcactcatcaaattgacaggccatagcctgggggtggccctctgggctgtctctggggctttgagggtaacccaggggaggatggtctgcccattggcccgttgctgtgtcctgtgtattcctttcatctttctcattatgatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381938 - DNA, 5585 bp, Homo sapiens
ccgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381939 - DNA, 4744 bp, Homo sapiens
ttttttttttggcagggacggagtctcactgtgttgcccaggagaattaggctgtacaaggctggtgtttaactattttatggtttggtaacagaaagaaaatatttactaactgggtatggcacatttttgtagtcctagctacttgagaggccaaagtgggaagatgacttgaacccaggagttcaaggccagcttgggcaacatagcaagagatcctatcccttaaaaaaaatatttacatgtattttactatatatatagtatttacatcgggaggaagaaatgaaaggcatggggtacatggcatttcaagaaaataaattcttccatgagagggagttatctggtaggatggaaagtgagtttggagagagggtggctctaagagtcaacttatctgtctgtgtctagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaagggttgctgacggacgcggattgtgagagcgtctaccccgttgtgtatccttctaatcgaggcctggcttctgccgcaggcgaatttctgtactggaaacttttctaccctgagtgcgagataagaacgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381940 - DNA, 2354 bp, Homo sapiens
ttttttttttggcagggacggagtctcactgtgttgcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttgctgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccaaaaaaaaaacacaaaacaaaaaaacaaaaaaaaaagaagaccacaaccacaacaaaaccgcgggcacccccagcacggcgcgccgcgaacaaaaggcggagaccacacaccgcgccacggggcagacagagcgcacagacagcccaagcgccgcagcgccacaacacggcaccaacgcgccagagaccaaagacagcgcggcgagcaacgcgcaaacgacagggaagcccacagaac

SEQ ID NO: 381941 - DNA, 257 bp, Homo sapiens
cccgactcttccatcaggacaagcagcttttgtaagttggtgggtggatagagatgtggattagggaagggcctgctgagggcccagtagccccttcaggcttttggttctacctctttcataggctgtcctatctagaaaagtgcctgcagcatgtctcccaggcacctggccatccctggggcccagtcaccacctactgccactccctcagccctgtggagaacacagcagagaccagccctcaggtcctcccc

SEQ ID NO: 381942 - DNA, 919 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctct

SEQ ID NO: 381943 - DNA, 2996 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381944 - DNA, 2251 bp, Homo sapiens
tgcgcggggaggtggtgcgcggggaggtggagggcgaggggcggggctacctctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381945 - DNA, 2745 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaaca

SEQ ID NO: 381946 - DNA, 2520 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattagaaaacaaaaagggggcgcaaaagtatcctcagggccagttacgcgtaccagtttctgtcaaaagggcctataggagcgttttaggaaggccgcctcgttaacacgtgggctggacacggtccttgcctgggagcaccccctcgggcattgggccacctccgttaactcggagtacactagttggacacgcttcgcgatgcgtattaagc

SEQ ID NO: 381947 - DNA, 2656 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaaaaacaaaaaaaaaaaaaaaaaaaaaactccgagggcatctttattttttcggggggcgccggaaaaaggagggttttaggaaagggggccctgttggccattacctgggttttccagtgacccagtttttcttgtgttccaagtggggctaaatcttggccgggttcccccaatatatggggagggtcggaattaaatttccggataaaacccagggtttaccctgtgcttttatggactccggcgaacagggcaggaaagacaaaaaacagccgaagacgcagaaacaacaagcactagagacagggggtacacaaccaacttggttacacaccacacgtgcgccacgacacgaacgcgcacacacaacacatgcgaaactaaaaaacacacatatgacagcaacaacaaccagacacaacgccaacaacaatcaacaaaaacaacaaccaaacaacacaacaaaaagcgaaacaaacaacaataatcaagtaacacgacg

SEQ ID NO: 381948 - DNA, 3002 bp, Homo sapiens
  misc_feature (1764)..(1764): n is a, c, g, or t
  misc_feature (1770)..(1772): n is a, c, g, or t
  misc_feature (1777)..(1779): n is a, c, g, or t
  misc_feature (1790)..(1791): n is a, c, g, or t
  misc_feature (1793)..(1793): n is a, c, g, or t
  misc_feature (1798)..(1798): n is a, c, g, or t
  misc_feature (1803)..(1803): n is a, c, g, or t
  misc_feature (1815)..(1815): n is a, c, g, or t
  misc_feature (1820)..(1820): n is a, c, g, or t
  misc_feature (1854)..(1854): n is a, c, g, or t
  misc_feature (1856)..(1856): n is a, c, g, or t
  misc_feature (1861)..(1861): n is a, c, g, or t
  misc_feature (1863)..(1863): n is a, c, g, or t
  misc_feature (1869)..(1869): n is a, c, g, or t
  misc_feature (1873)..(1873): n is a, c, g, or t
  misc_feature (1879)..(1879): n is a, c, g, or t
  misc_feature (1881)..(1881): n is a, c, g, or t
  misc_feature (1898)..(1898): n is a, c, g, or t
  misc_feature (1918)..(1918): n is a, c, g, or t
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttcntttttnnnttttnnntccttatttcnntnttttntgtcntgcttttacatntttcnttttttttttttgaagtttttttcatatttttantnatttntncctttncttntttttntntctgcaatagttaaagnacttggattaaacccagagnaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381949 - DNA, 1839 bp, Homo sapiens
  misc_feature (1782)..(1783): n is a, c, g, or t
  misc_feature (1789)..(1789): n is a, c, g, or t
  misc_feature (1795)..(1797): n is a, c, g, or t
  misc_feature (1809)..(1809): n is a, c, g, or t
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttcgggcctcctttgggaaggnncatccnctaagnnngggtgaaaccgnggccgggatcgcactttaccaagcactcgg

SEQ ID NO: 381950 - DNA, 2946 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381951 - DNA, 2046 bp, Homo sapiens
cttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381952 - DNA, 1344 bp, Homo sapiens
ccccacgtaaagccccgttttttaaaaaggggattttgtttcaaatgtggaaaacactttaacctattttcgggtaaattcctttgaatttaaaaagggtttttccaattttggcccattgggttaaaaattaggttttttaccaaaaaatttaccggatttttccaaaattttacggcttcaaattccctttgccaattaaggtgggcaaatttttggaaaggccaacggttcgggcctttttggtattacgccaacttgggaaaaggggatttttttcaaagcgatttaatttgggaaccccaaggtttttccaattccgacgtttttaaaacccggcccattaatttttaaacggccccctataaggggaaattgcccaattagccccaaattcggccccaatgaaaaaatttgcccaatttaaaaatcgattgggccaaaggggccaaaaagtttttttttttttttttttttttttgttttggtttttttttgttgttttttttctttgttttttttttcttttcttttttttttttttttttttttttttttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381953 - DNA, 1193 bp, Homo sapiens
  misc_feature (959)..(959): n is a, c, g, or t
  misc_feature (965)..(966): n is a, c, g, or t
  misc_feature (978)..(978): n is a, c, g, or t
  misc_feature (980)..(980): n is a, c, g, or t
  misc_feature (986)..(987): n is a, c, g, or t
  misc_feature (990)..(990): n is a, c, g, or t
  misc_feature (992)..(992): n is a, c, g, or t
  misc_feature (1005)..(1007): n is a, c, g, or t
  misc_feature (1010)..(1010): n is a, c, g, or t
  misc_feature (1019)..(1019): n is a, c, g, or t
  misc_feature (1021)..(1021): n is a, c, g, or t
  misc_feature (1028)..(1028): n is a, c, g, or t
  misc_feature (1040)..(1040): n is a, c, g, or t
  misc_feature (1043)..(1045): n is a, c, g, or t
  misc_feature (1050)..(1050): n is a, c, g, or t
  misc_feature (1072)..(1072): n is a, c, g, or t
  misc_feature (1075)..(1075): n is a, c, g, or t
  misc_feature (1152)..(1152): n is a, c, g, or t
  misc_feature (1178)..(1178): n is a, c, g, or t
  misc_feature (1190)..(1190): n is a, c, g, or t
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcatagtccttcaatggtntttttnnttgctgttcctntncaggannttngntccattttttttnnnatnttgtttttntnttttttncttttttttttntcnnnttttnttttttttttggtcattttttnacntgtttttgcagcaggctgtgggcagaatcctgttatttttttttttttttttttttttttttttttttttttttttnttttttttttttttttttttatgatntgtgggttaggntta

SEQ ID NO: 381954 - DNA, 825 bp, Homo sapiens
tactactactaaattcgcgcccgcgtcgaccttttatttataacaatgttaaatgcaattgtcttgtaccgtgagttgagtattacacattaaagtaaagtccaagctgtaaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381955 - DNA, 354 bp, Homo sapiens
ttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggt

SEQ ID NO: 381956 - DNA, 336 bp, Homo sapiens
acagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggc

SEQ ID NO: 381957 - DNA, 370 bp, Homo sapiens
tctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcga

SEQ ID NO: 381958 - DNA, 2154 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaa

SEQ ID NO: 381959 - DNA, 2066 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattc

SEQ ID NO: 381960 - DNA, 2333 bp, Homo sapiens
ggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381961 - DNA, 2160 bp, Homo sapiens
  misc_feature (33)..(33): n is a, c, g, or t
  misc_feature (41)..(41): n is a, c, g, or t
tcgagaactgatttatgatgtgcccagagtcancccggatntgtatttcatcacgtgcagctaaagtaactaaatggtacgtggccttacaattaacaggtgcatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381962 - DNA, 2266 bp, Homo sapiens
ggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381963 - DNA, 2697 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381964 - DNA, 2956 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381965 - DNA, 2708 bp, Homo sapiens
catatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgctgcgggccgggctcgcactcgagattctcgcccgtgggattccagtcctgagctgaacgagagataagtctttgtcaccccccagtctttactgtttcgagaaaccctaagattttttaaaaaaaagcccaaaacgtcaagtcggggaactccaacattggggtgtccagaaacactggggtttcaggcgctctgtaaatgcgtccgaggtccgcggttctgcccgcaggcccagaccccggcctcacttccgccccgcgccccgcgccccggccctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggctcctcacttggcttacttgagaacaggagtaaagatagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaagaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381966 - DNA, 2040 bp, Homo sapiens
gcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagt

SEQ ID NO: 381967 - DNA, 1172 bp, Homo sapiens
tggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcata

SEQ ID NO: 381968 - DNA, 2602 bp, Homo sapiens
tggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaagtggccagccttttttattttgtcaccaaggtacacacagtcctttatttataaattccttaacagagaaaaacacctttgtaaggctcaacttacctattccagcaagcacactttttctgtcattttttctttcttttcaaatttgatattgtcattattttaaaatagtaagttttctttaatagtcttttgggacctaacataccctttctcatacaattcctaatgctctgtttatggcagataatctgtaatgttatgaagacctatcaaaaagttttaaaagtatttctgtcttcaaaggtagtaagacaggattaaatttttattagaatagacaaatcagtgaatggtatgcatgtatctagtggttactagaactcaggatcacacaatatagtagcatcacgatctgtgtatatttttgatcaagatgataataatggccttacttgggtttttatcgtttatcaaatcttacatacaaaagagtggaagtattcctttacaaaatttctaaggaaaatatttcttccaatctatcacaattatagaatggatatatgtttctgaaaagtttttgaaagaaagcaaaagttctagaactaaaagtaagctggtatttaatatcccgttgatatttagaaaagattgttaataagaaatggaggatgcatttagtactatttttatccactagttcactttcagtacagttatgtatacttgttttgattgagagtgtgacatacatgttaaatcagattagcttgtttcttttaaatatacatatacacaaatacatataattttttctcctttttgttgtgcatatctctatgcatttttaaacttttagatttgtgaatgacctatgtgtaaatttttgtttttataaaccagaaattatacaagttttaatgtgtgtcaagaacttgttccatacaactgtggtatcgagcaataatgttaataacttttggaattatataaactatgcttaataatttgtattgagaattggtaccactatacaatacttttttcctgtattaaatcttttaaataccagtttcattaatttatatacctgtatttttaaaagtatttctttgtacttgccaaagtactgtaatcctatataaatttgaatagtcaaatgccagtatctcatgtcctatatcctgtcttggatattaggagctatcttaaaaactaggatttaagatttttttttgcttgagaattatatgttttccttgccccccaagtaacaacttgaatttgtagaacacttttcctgtgaagagttcaaagtacaaagaactcaaatacttattttatttaacttgtatctagggtgtgtcctaccaccttaaagtagtgcaattaaaaataatgccatctagaaacttcagtattc

SEQ ID NO: 381969 - DNA, 1376 bp, Homo sapiens
tggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagagtaagttgaattatatattttaatttaaatttagaagtggacaagcaagtcttgcatttatctagtttttattttttgtattgaatgaatcacactatcctgaataaaatatgaaaataatctgatccaggagaggagtgagtcagtaaagttactatatatccaagtgctgttattaaatagccatctaaaaattatatttataattttagaagcaaggagtagtgtatggcattgtctgtatctgtacattgacggtggtgtggtatagtgatcaaggatgctggcttcagctctaccacttttctctgtgaccttaggcacgtttcctaacctctttaaaccctacttgacacaactgtaaaatgttcacctactacttgaatataaaggtaaaatgaaaatgtttggaaaactcttagctgaatatctcaaaggaagtggttaataagtattaattaatagtattcttactgactgtaagatggtacccatacaagaaataaaatggttacaatggttgtttcttgttggtaagattatgggacattcttttctgctttttatattttacaagtttcctgtagtgagcacaaagtgattctgtaatcagaaaaaataatttcaaagactcattattttgactgcttataataaaaaattctggccaggca

SEQ ID NO: 381970 - DNA, 2055 bp, Homo sapiens
gttccagaggatccccgtcgtccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaagtggccagccttttttattttgtcaccaaggtacacacagtcctttatttataaattccttaacagagaaaaacacctttgtaaggctcaacttacctattccagcaagcacactttttctgtcattttttctttcttttcaaatttgatattgtcattattttaaaatagtaagttttctttaatagtcttttgggacctaacataccctttctcatacaattcctaatgctctgtttatggcagataatctgtaatgttatgaagacctatcaaaaagttttaaaagtatttctgtcttcaaaggtagtaagacaggattaaatttttattagaatagacaaatcagtgaatggtatgcatgtatctagtggttactagaactcaggatcacacaatatagtagcatcacgatctgtgtatatttttgatcaagatgataataatggccttacttgggtttttatcgtttatcaaatcttacatacaaaagagtggaagtattcctttacaaaatttctaaggaaaatatttcttccaatctatcacaattatagaatggatatatgtttctgaaaagtttttgaaagaaagcaaaagttctagaactaaaagtaagctggtatttaatatcccgttgatatttagaaaagattgttaataagaaatggaggatgcatttagtactatttttatccactagttcactttcagtacagttatgtatacttgttttgattgagagtgtgacatacatgttaaatcagattagcttgtttcttttaaatatacatatacacaaatacatataattttttctcctttttgttgtgcatatctctatgcatttttaaacttttagatttgtgaatgacctatgtgtaaatttttgtttttataaaccagaaattatacaagttttaatgtgtgtcaagaacttgttccatacaactgtggtatcgagcaataatgttaataacttttggaattatataaactatgcttaataatttgtattgagaattggtaccactatacaatacttttttcctgtattaaatcttttaaataccagtttcattaatttatatacctgtatttttaaaagtatttctttgtacttgccaaagtactgtaatcctatataaatttgaatagtcaaatgccagtatctcatgtcctatatcctgtcttggatattaggagctatcttaaaaactaggatttaagatttttttttgcttgagaattatatgttttccttgccccccaagtaacaacttgaatttgtagaacacttttcctgtgaagagttcaaagtacaaagaactcaaatacttattttatttaacttgtatctagggtgtgtcctaccaccttaaagtagtgcaattaaaaataatgccatctagaaacttcagtattc

SEQ ID NO: 381971 - DNA, 2518 bp, Homo sapiens
tggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaagtggccagccttttttattttgtcaccaaggtacacacagtcctttatttataaattccttaacagagaaaaacacctttgtaaggctcaacttacctattccagcaagcacactttttctgtcattttttctttcttttcaaatttgatattgtcattattttaaaatagtaagttttctttaatagtcttttgggacctaacataccctttctcatacaattcctaatgctctgtttatggcagataatctgtaatgttatgaagacctatcaaaaagttttaaaagtatttctgtcttcaaaggtagtaagacaggattaaatttttattagaatagacaaatcagtgaatggtatgcatgtatctagtggttactagaactcaggatcacacaatatagtagcatcacgatctgtgtatatttttgatcaagatgataataatggccttacttgggtttttatcgtttatcaaatcttacatacaaaagagtggaagtattcctttacaaaatttctaaggaaaatatttcttccaatctatcacaattatagaatggatatatgtttctgaaaagtttttgaaagaaagcaaaagttctagaactaaaagtaagctggtatttaatatcccgttgatatttagaaaagattgttaataagaaatggaggatgcatttagtactatttttatccactagttcactttcagtacagttatgtatacttgttttgattgagagtgtgacatacatgttaaatcagattagcttgtttcttttaaatatacatatacacaaatacatataattttttctcctttttgttgtgcatatctctatgcatttttaaacttttagatttgtgaatgacctatgtgtaaatttttgtttttataaaccagaaattatacaagttttaatgtgtgtcaagaacttgttccatacaactgtggtatcgagcaataatgttaataacttttggaattatataaactatgcttaataatttgtattgagaattggtaccactatacaatacttttttcctgtattaaatcttttaaataccagtttcattaatttatatacctgtatttttaaaagtatttctttgtacttgccaaagtactgtaatcctatataaatttgaatagtcaaatgccagtatctcatgtcctatatcctgtcttggatattaggagctatcttaaaaactaggatttaagatttttttttgcttgagaattatatgttttccttgccccccaagtaacaacttgaatttgtagaacacttttcctgtgaagagttcaaagtacaaagaactcaaatacttattttatttaacttgtatctagggtgtgtcctaccaccttaaagtagtgcaattaaaaataatgccatctagaaacttcagtattc

SEQ ID NO: 381972 - DNA, 1032 bp, Homo sapiens
agaagggctggaataagttctcaaagtttcctggagtcaacttctggtgctagacattcaaaaaaacctagactttgtcaaatggactggtcctggcagattcatagccacaggcagccttatatgcactccacccttccacagtcagtattcagaagcttggtctgactatttctcatcttaaatggattctaattgatctctggagtcatttttaagtccaacttaaagaggtggttgtcagggctggcatttattcctcttgaggtagttactataataaatagcttccacttcctttgaggagtacagacattgtatacaaaaacatgatactgaatcaactcagctttaactcagaagtgccactggtggtgaagtgcatgcacttatacttatcttaccatcaatgctgtacaggtccagggtaccacccatgctcctgtcccagggaggaaccaggtacaggatgaaggcaatccggcgcccttccagctcatcatcatggcacagcagggcatctgcaatagtttaatggacaccttagatccctgcagatagtgaccagctgacacctgactctgcatttaatatcagtccgtttgacattcaactgtaatgtcagctccagctttaaatgtcctccagctttaaaatgacacttatttctcctcttttataagtaaacaaataagtcaatatagaaaactctaaaaataaagagcacataattagatagatccagatataatcgctaacaatatttttacatatcatcttccagtatttttcctacatatatgtatttactttaaaaaaaatagcatccgacagtgtctatttgtggcctgctttttaaattacatggcaagtatctttccctatcaatatacacacttggtatcacttttaatggctgtagttattctactatatggattatgaacttacctccttccacccttaatagattttctatttgttaattaagttgtttctatttcttggctactataaagactaatttaatga

SEQ ID NO: 381973 - DNA, 2741 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtg

SEQ ID NO: 381974 - DNA, 765 bp, Homo sapiens
  misc_feature (728)..(729): n is a, c, g, or t
tacctttcacactccagagctggcaccagtcacttatgtttcagtcagtcggcctagtgtttggcttttgtctccggacttcaaagggagagaaaaccttcagctccttttcttagaccttcctgcatcctctaaagaaaaacctactatatataacccaaaggaaatatataaacatatatatataaataaaaccatcaaggcccaattagcaaaaaagagactgaaaattaatgctaagtgtctaacttaaaaatttagaaaagaacaataggataaacccaaggaagcagaaatacagccagagatttatacctgaattctgctgttttgggtcgatgctttgacttctttagaaataatctttgctaggtgactatgagctttgatccttttctgtaaaactgactgttggtttctaggtttgagacagtctctaagtcagttttttcaataattccctcaccaagttattttttttagggaatggtaagataaatcatatttcaagtataactcttttccctcctggttttatgttgttttaaaactgacgtctaattttataatttcatgtctaacaatcttttggttcctgatgtttcttcttatgcagttggaaaaccaaagaaccaggtgatcactgcttgtcgggatgcaattcgaagcaataacatcaacacactgttcaaaatcatgcgagtggggacagcttcttcctagggccnnccccgttccttctctatgcccactctcatcactctc

SEQ ID NO: 381975 - DNA, 816 bp, Homo sapiens
tgctccattccacatgtccatgctccaaggcctcacagactttcgtgaatttctcaggcttaagaaactccttcaggagaatttcagaactttcttcaaactcttcttgaatttgaacttggtaatccatgtccagataagtagggttgatccaatcatacaaaatctcatgatcttgtgggatgtgagggctccgaggtatggggggttcaaagtagttgggaggccgagtcaatgatggaccatgaaaccagccacttatagacaaacgtgacttttcttcagacagcacttcagacacctggtgaaaggacacaggagatacttcaaagaaaaccagtttgttccacgaagggataagagacttgacaatctgcttcggctgaaagtgttcatcaatgctgtacaggtccagggtaccacccatgctcctgtcccagggaggaaccaggtacaggatgaaggcaatccggcgcccttccagctcatcatcatggcacagcagggcatcagtgaattcatatttagcacaggacatgtcaatggttgattccaggtcaattttagaaatatcagaaagccaggaccggaaatcttcaaacagaattttccttaaagtggagatgtgaggctctcttctcttcttcaaatcatcagattctcatggaagtccaagttcatcagttccttctgaagcccttctaagaagtcttggctttggatgaagtttgggatcacacagtgaagaaaagggtccatgtccatgacaatgacttgagggtactgcaactcccggcatgtcccctttatcgtgtt

SEQ ID NO: 381976 - DNA, 656 bp, Homo sapiens
ttgtgtttcattgattggccatagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacattgaaaacaaattgaaaaagtcgttctttgggaacctcttacggccctaaataagaaactctggctcaaatgcataataaaaatccccgtgtgaacaaacccacgcagaatcgtgtggtg

SEQ ID NO: 381977 - DNA, 3007 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaactttgtgttgattgattataaaatcaccaccaaatcagaattgc

SEQ ID NO: 381978 - DNA, 3288 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatggtaagacagtactcacagctggtatttagaggcacctgtgccatcttggagtcattcttttttttttttttgagacagagtcttcctctgtcttggctcactgcaagctctgcctcccgggttcatgccattctcctgtctcagcctcccaagtagctgggactacaggcgcccaccaccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381979 - DNA, 3089 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagaggcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381980 - DNA, 2801 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggggccaagaaatgaagcttcaggcctgtgaagttggagagcagcaagaatagtgcctcagagcgaaataacttcatgcactccttcaatatctcaggaagcttactctcctcagctttctcataaaacctgaaaaacagcaatgtcaagttgttcatcaaagccacagatgtaaaatgactcacagaataaaagctgatcgttagctttgtacc

SEQ ID NO: 381981 - DNA, 1260 bp, Homo sapiens
gtttccacaattttttttctcgcggcttctttttatacctttctctcgactcttcttttcaaacatgttcctttaatatctttattctcaaggcctaaatacttcgccttacttgagctccaatttcttcatcctaaacttatcctctcaattttcagacttacttcccctcacctttctcataacccttttttaagggacctcgctcctcccaatccacatgtccatgcctccagccctcgcagacctttccttgaatgtctcagccttaagaaactccttcaggagaatttcagaactttcttcaaactcttcttgaatttgaacttggtaatccatgtccagataagtagggttgatccaatcatacaaaatctcatgatcttgtgggatgtgagggctccgaggtatggggggttcaaagtagttgggaggccgagtcaatgatggaccatgaaaccagccacttatagacaaacgtgacttttcttcagacagcacttcagacacctggtgaaaggacacaggagatacttcaaagaaaaccagtttgttccacgaagggataagagacttgacaatctgcttcggctgaaagtgttcatcaatgctgtacaggtccagggtaccacccatgctcctgtcccagggaggaaccaggtacaggatgaaggcaatccggcgcccttccagctcatcatcatggcacagcagggcatcagtgaattcatatttagcacaggacatgtcaatggttgattccaggtcaattttagaaatatcagaaagccaggaccggaaatcttcaaacagaattttccttaaagtggagatgtgaggctctcttctcttcttcaaatcatcagactgctggaacttatataaatcattatacttctcatggaagtccaagttcatcagttccttctgaagcccttctaagaagtcttggctttggatgaagtttgggatcacacagtgaagaaaagggtccatgtccatgacaatgacttcgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgagagggtactgcaactcccggcatgtcccctttatcgtgtt

SEQ ID NO: 381982 - DNA, 1814 bp, Homo sapiens
cttttgaagctgaatagcaatattattgctgaattggccagtccactgaacgaggctgatgggcatcggggcataatcccagccaataccaggctccacaccacgctctcagtcagcctggggaatgagacccaaactgctcatacagaattacgcatttccacttctaatggtaagacagtactcacagctggtatttagaggcacctgtgccatcttggagtcattcttttttttttttttgagacagagtcttcctctgtcttggctcactgcaagctctgcctcccgggttcatgccattctcctgtctcagcctcccaagtagctgggactacaggcgcccaccaccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381983 - DNA, 1244 bp, Homo sapiens
  misc_feature (1234)..(1234): n is a, c, g, or t
  misc_feature (1236)..(1236): n is a, c, g, or t
  misc_feature (1238)..(1238): n is a, c, g, or t
gtttccacaattttttttctcgcggcttctttttatacctttctctcgactcttcttttcaaacatgttcctttaatatctttattctcaaggcctaaatacttcgccttacttgagctccaatttcttcatcctaaacttatcctctcaattttcagacttacttcccctcacctttctcataacccttttttaagggacctcgctcctcccaatccacatgtccatgcctccagccctcgcagacctttccttgaatgtctcagccttaagaaactccttcaggagaatttcagaactttcttcaaactcttcttgaatttgaacttggtaatccatgtccagataagtagggttgatccaatcatacaaaatctcatgatcttgtgggatgtgagggctccgaggtatggggggttcaaagtagttgggaggccgagtcaatgatggaccatgaaaccagccacttatagacaaacgtgacttttcttcagacagcacttcagacacctggtgaaaggacacaggagatacttcaaagaaaaccagtttgttccacgaagggataagagacttgacaatctgcttcggctgaaagtgttcatcaatgctgtacaggtccagggtaccacccatgctcctgtcccagggaggaaccaggtacaggatgaaggcaatccggcgcccttccagctcatcatcatggcacagcagggcatcagtgaattcatatttagcacaggacatgtcaatggttgattccaggtcaattttagaaatatcagaaagccaggaccggaaatcttcaaacagaattttccttaaagtggagatgtgaggctctcttctcttcttcaaatcatcagactgctggaacttatataaatcattatacttctcatggaagtccaagttcatcagttccttctgaagcccttctaagaagtcttggctttggatgaagtttgggatcacacagtgaagaaaagggtccatgtccatgacaatgacttcgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgaccccggccataaangncnaattgg

SEQ ID NO: 381984 - DNA, 1985 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcaggtgaccctttgcaagtcacagttcatttcaggacagcacttagaggagggcaagatgtataaattttccatatgcccagtggattcttgggggcctgagaaaccatttaatggttctgtctacccaaagtttctcatgaccttttatttcctcagtttgaaacctgt

SEQ ID NO: 381985 - DNA, 2312 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatggtaagacagtactcacagctggtatttagaggcacctgtgccatcttggagtcattcttttttttttttttgagacagagtcttcctctgtcttggctcactgcaagctctgcctcccgggttcatgccattctcctgtctcagcctcccaagtagctgggactacaggcgcccaccaccacgcccagctaattttttgtatttttagtagagatagggtttcaccgtgttagccaagatggtctcgacctcctgacctcgtgatctgcccacctcagcttcccaaagttggagttgttcttaaactgtttttactcttccctgcagacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcaggtgaccctttgcaagtcacagttcatttcaggacagcacttagaggagggcaagatgtataaattttccatatgcccagtggattcttgggggcctgagaaaccatttaatggttctgtctacccaaagtttctcatgaccttttatttcctcagtttgaaacctgt

SEQ ID NO: 381986 - DNA, 1097 bp, Homo sapiens
tacctttcacactccagagctggcaccagtcacttatgtttcagtcagtcggcctagtgtttggcttttgtctccggacttcaaagggagagaaaaccttcagctccttttcttagaccttcctgcatcctctaaagaaaaacctactatatataacccaaaggaaatatataaacatatatatataaataaaaccatcaaggcccaattagcaaaaaagagactgaaaattaatgctaagtgtctaacttaaaaatttagaaaagaacaataggataaacccaaggaagcagaaatacagccagagatttatacctgaattctgctgttttgggtcgatgctttgacttctttagaaataatctttgctaggtgactatgagctttgatccttttctgtaaaactgactgttggtttctaggtttgagacagtctctaagtcagttttttcaataattccctcaccaagttattttttttagggaatggtaagataaatcatatttcaagtataactcttttccctcctggttttatgttgttttaaaactgacgtctaattttataatttcatgtctaacaatcttttggttcctgatgtttcttcttatgcagttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381987 - DNA, 1046 bp, Homo sapiens
  misc_feature (1036)..(1036): n is a, c, g, or t
  misc_feature (1038)..(1038): n is a, c, g, or t
  misc_feature (1040)..(1040): n is a, c, g, or t
agaagggctggaataagttctcaaagtttcctggagtcaacttctggtgctagacattcaaaaaaacctagactttgtcaaatggactggtcctggcagattcatagccacaggcagccttatatgcactccacccttccacagtcagtattcagaagcttggtctgactatttctcatcttaaatggattctaattgatctctggagtcatttttaagtccaacttaaagaggtggttgtcagggctggcatttattcctcttgaggtagttactataataaatagcttccacttcctttgaggagtacagacattgtatacaaaaacatgatactgaatcaactcagctttaactcagaagtgccactggtggtgaagtgcatgcacttatacttatcttaccatcaatgctgtacaggtccagggtaccacccatgctcctgtcccagggaggaaccaggtacaggatgaaggcaatccggcgcccttccagctcatcatcatggcacagcagggcatcagtgaattcatatttagcacaggacatgtcaatggttgattccaggtcaattttagaaatatcagaaagccaggaccggaaatcttcaaacagaattttccttaaagtggagatgtgaggctctcttctcttcttcaaatcatcagactgctggaacttatataaatcattatacttctcatggaagtccaagttcatcagttccttctgaagcccttctaagaagtcttggctttggatgaagtttgggatcacacagtgaagaaaagggtccatgtccatgacaatgacttcgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgaccccggccataaangncnaattgg

SEQ ID NO: 381988 - DNA, 1432 bp, Homo sapiens
gtttccacaattttttttctcgcggcttctttttatacctttctctcgactcttcttttcaaacatgttcctttaatatctttattctcaaggcctaaatacttcgccttacttgagctccaatttcttcatcctaaacttatcctctcaattttcagacttacttcccctcacctttctcataacccttttttaagggacctcgctcctcccaatccacatgtccatgcctccagccctcgcagacctttccttgaatgtctcagccttaagaaactccttcaggagaatttcagaactttcttcaaactcttcttgaatttgaacttggtaatccatgtccagataagtagggttgatccaatcatacaaaatctcatgatcttgtgggatgtgagggctccgaggtatggggggttcaaagtagttgggaggccgagtcaatgatggaccatgaaaccagccacttatagacaaacgtgacttttcttcagacagcacttcagacacctggtgaaaggacacaggagatacttcaaagaaaaccagtttgttccacgaagggataagagacttgacaatctgcttcggctgaaagtgttcatcaatgctgtacaggtccagggtaccacccatgctcctgtcccagggaggaaccaggtacaggatgaaggcaatccggcgcccttccagctcatcatcatggcacagcagggcatcagtgaattcatatttagcacaggacatgtcaatggttgattccaggtcaattttagaaatatcagaaagccaggaccggaaatcttcaaacagaattttccttaaagtggagatgtgaggctctcttctcttcttcaaatcatcagactgctggaacttatataaatcattatacttctcatggaagtccaagttcatcagttccttctgaagcccttctaagaagtcttggctttggatgaagtttgggatcacacagtgaagaaaagggtccatgtccatgacaatgacttctcttcaaagcacttgacaacggaaagaaaaattacggcaaactctagaaggggatgcctggcgcatgaagcagagctctgaacacctaaggtgatatttaaagctgaggctggaatcgttcaacgtaggcgcctttccttggtcaaagcgcgtttattttcatacatcatggagtcaaactacaggcgcgtagagacgagtacactagggagtcaagctggcagctcacgacaaatgccctggctagactctcctgggacagctgagcaatgcccttgcaggagaaatgacatcagccactcctgtatttgtccacatgtgtattgggccttactcagggaaacatttactgaagcctgcaagcattagtgtgtcgctcccattcaccgactttccgaggtaaatattatgaactatc

SEQ ID NO: 381989 - DNA, 413 bp, Homo sapiens
ataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggcaagtataacctttataaccataaaattgtcattactcattaatgtccattttttatgcttagaagagatcagatcatttattttggtctgtttgttgtatgactgttatagtataggtaaacaacatggagattttgctgttaacatctgctttatgtactcggaacttatttatttggttatggttgctaat

SEQ ID NO: 381990 - DNA, 675 bp, Homo sapiens
gggggttcaaagtagttgggaggccgagtcaatgatggaccatgaaaccagccacttatagacaaacgtgacttttcttcagacagcacttcagacacctgaaaggagaagcccagtagcacatcaacacgaagaatagggggattaccgccaatgcacattaatttcagggtcctccatgctaagcattaaaacaacatcagataacaagtctaacaggaagctgtcatgtttggataatgggtgattaaaaaacataatccttgctactctatttgtggcttacagtctttacctggtgaaaggacacaggagatacttcaaagaaaaccagtttgttccacgaagggataagagacttgacaatctgcttcggctgaaagtgttctgcaccaggaaagaacacatcaataaattatcattaaccacttccagcctgcctcattttactcttgacaatttccaaacttctgagggcatctagatgtgcccttcagaccctgaaataccgccctttccatctgcttcactcatacttgcgagtttgactacgtggcatctgttcttactacaccatccatctattattgagaagggctggaataagttctcaaagtttcctggagtcaacttctggtgctagacattcaaaaaaacctagactttgtcaaatgg

SEQ ID NO: 381991 - DNA, 663 bp, Homo sapiens
ggaatatccaagggattcttaacccactaagcatactgctgatactaatgttagtgttatcatcatttctatgtttcacttgaagaagggaatgacaaaaacattctaatcaggaacaaaacaaaaactccccagtgatgcctattcacccatttgggaagcaaaattgcatgccaaacaaaatattcagaacaacatacgctaagcttaccttaagaaactccttcaggagaatttcagaactttcttcaaactcttcttgaatttgaacttggtaatccatgtccagataagtagggttgatccaatcatacaaaatctcatgcttacgaagaggcagcagatgcaaaatgtgagttaataattcctattgcttttgctcttacatcatttcacactaataaaatacatgcaaatcctcattttataagtttctcctattaaagtactggaaaactctgcttgagaaagacactctcaaaagtttacttaagaaaagtgtaggccgggtgcagtggctcacacctgtaatcccagcactttgggaggccaaggtgggtggatcatttgaggtcaggagtttgagatcagcctggccaacatggtgaaaccctttctctactaaaaatatgaaaattagccaggcgtggtggtgggcacctg

SEQ ID NO: 381992 - DNA, 2894 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttg

SEQ ID NO: 381993 - DNA, 2961 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381994 - DNA, 3561 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagaggtaagaagctccacctcgaactatggtaaccttgagcaagatagatcagtactgtcagatgaaacatcaagtgagagtgctggggcatctccaaacccaggtggttttaggataaaagcttggggagggggtcagacagagctgtatgttatggtaagaaaagcaataaaaatcctaattaagatatattttgaaaagactgattaaatagagaaaaattattgcatatagttgaatacataaaggcatttcttttaatgagttaatacatgcaaataataataatggcaatcatttattatgtacctattgtatgccaggtagtgctctaagtactttatatgaagtaacatattgaatccttacaacaaccctaataggaagataaattattattatttctatagatgaggaaaatggtgttctggttttttgtttgtttgtttgtttgttttgaggcagagttttactccatcacccaggctggagtgcggtggtgcgatctcggcttactgcaagctccacctcccaagttcaagtgattcgcatgcctcagcctcctgagtagctgggactacaggcacgcaccaccacgcctggatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381995 - DNA, 3177 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatccttaaaaagtcacgttttccatttgattgggtcaaaatatcaggaaatttcacctgaagtatttgtaccgagatcctgtagttctaataaattcaccaaagttggggagaacttaggtttttgtttttaagagcaggtaattgatgacctaaaagtatacctggttatacttgcggttttttccttctgttcagtccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381996 - DNA, 2160 bp, Homo sapiens
tgtcaagtatgcagggtgcagcttggatgtggtgctagaaggggaagcctctgggctgagcatgtaggctcgtcagtagagttcaacccgcaggagtaaattactgcagtgagaaacaaccgcacccgcggcccagcaggggttccactgcgcagccgcaaaaggcgccgaggctccaccgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcaacattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggtgagtatctcgcttttctctttcaatgcttttacacagtagaatcctttagatgttatttcatagaaagggaaaattacattaatgtgttatattggtagcagtaaatatgatatgaaagaattctctaacttgggggtggcttgtaacctgtaataaaaatattgctaaaataccttctctcactttgaaaaagcatctgagcaatcctc

SEQ ID NO: 381997 - DNA, 815 bp, Homo sapiens
gtgtcttttcatttgtctgggttcaagaagtttgtgaggcctttttcattcctgagtgttcatggtctccaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgtta

SEQ ID NO: 381998 - DNA, 513 bp, Homo sapiens
gtttccacaattttttttctcgcggcttctttttatacctttctctcgactcttcttttcaaacatgttcctttaatatctttattctcaaggcctaaatacttcgccttacttgagctccaatttcttcatcctaaacttatcctctcaattttcagacttacttcccctcacctttctcataacccttttttaagggacctcgctcctcccaatccacatgtccatgcctccagccctcgcagacctttccttgaatgtctcagccttaagaaactccttcaggagaatttcagaactttcttcaaactcttcttgaatttgaacttggtaatccatgtccagataagtagggttgatccaatcatacaaaatctcatgatcttgtgggatgtgagggctccgaggtatggggggttcaaagtagttgggaggccgagtcaatgatggaccatgaaaccagccacttatagacaaacgtgacttttcttcagacagcacttcagacacctg

SEQ ID NO: 381999 - DNA, 593 bp, Homo sapiens
agtttcttgtgagctgttggctggaggcctcctttgcttccttgacacatggacctcttcatggggcatctcacacaaggtagcttgcttcataaaaggagagcaagtaggagggcaagagacagcactagtaaaacagaagtcatagtctttggtgatgtaataacacaagagacatcccttcacttttgtcacattcttctcattagaagcaagttgctaagtccagccagaactcaagggaaggagattaaacaggactgggaatatgaagaggtgggtattattgggagtcctgtcagaagctgcctgctacagggtctttagctttccttagattttcaaagaggtttgtgatccaagaagaatagagttttgaatctagattttatactaaacgatcactttagattttcaggagtgtgtgcctagtttgtgattaagttattctgcttcctttcttataattgagtttaacttattttcttcttcatattacctccattagttattggaactcaaaggtttaagtggaaaactaaatttaacatttataaatagccaaatttcagacaccaatgatggaataagga

SEQ ID NO: 382000 - DNA, 316 bp, Homo sapiens
ggataatttggtaaggaggaactgccagaaattttagagatgtgagtgcagcaactccggaaggagcttggatgtcattctcttatgttatcattaatgtgaaaattcagaagctgaaatagaacagcaccttccctccaagggtcccacgaatgccccagaggtctctgaccaccatatcacacaggagatggcctgactgacatgtcacagtgacccgtatggagtggcctcagggaatcaactctgttaacccggcagcttgggaaggacaaacaggctgacatatggctgagaagaaaaagtcagacagctc

SEQ ID NO: 382001 - DNA, 191 bp, Homo sapiens
tttttctttcaaatgtatacatatatttgaaatcttaggcatagggaaaaacttttatgtcatcttcagagctacagccatattttttagctagaaccaactcttaaatctctcccgacagaaccttaaggaaggggacaaagtgatctccaatggaaatgtgaaaggcataaaaaggaaaagttagatat

SEQ ID NO: 382002 - DNA, 431 bp, Homo sapiens
aacgaccaaccaaccaaacaaaaatcaagagggtgcagggagatggacattatcccacaccaaagcaggaggctacaatggtctagacctttgtggtggcaatctggaactgtaaaaacttaaatatgtactctttgaccaaattattccaattaataaatatcatgcataaatgcaaagataatgtccaaagttgttcactttagcattatttacatagtagcaagtacctggaagcatctttaaatacatctatcaatgggagattaagtaaatgaattgtgccttatgcatttcataatggcctgcaaatgccaaagattgaagtagatgctgggtgtgatagctcatacctgtaatcccagcagttcgggaggctgaggctggaggactgcttgaagccagaagtttgagatcagcctgggcaacat

SEQ ID NO: 382003 - DNA, 810 bp, Homo sapiens
caaagtgttgtgattgcaggcatgagtcatgctgcctggcaacaagtttaattcttatatggttttaaaatcgatgcttatctaaagagcctttgaaacatgacattttggtatttgttgtgactttactactggccttttgtagcaggtactgggtatctgcccctaccccaaccccgaactctgttagagtatctcgttcacatgtcagacagtgacttttggcccttggaggaagcagaaacctctctcctccatcacgttctgcccatccccttccaggatcctcgtgtttttcctgcttgcctgtgtgcatgcttccccgaatcccagggtgagcacatgggtagcagggtgcgagcactccagcctcagtgtgtgagcagaagggaggagacaccccttcatattgtcttatgcccgatttctgcctccaaagaaagaagaagtaaaaactaaaaggcagaaatgaaatccgcaggcagacagcccggcgcctcaccctaggcctggtagttaaagatctacccctgacctaatcggttatgttatctgtagattacagacattgaagagaaaagcactgtgaaaatccctgtcctgttctgttctgttctaattgccagtgcatgcagcacctagtcacgtactccctgtttgctcaatcaatcacgaccctctcatgcggacccccttagagttgtgagcccttaagagggacaggaattgctcactcggggagttcggtttttaagatgtgagtcttgccgatgctcctggctgaataaagcccttccttctttaacgtga

SEQ ID NO: 382004 - DNA, 853 bp, Homo sapiens
tcagttcaccaagagcagcactgagatgggtggatccaggtgcaccttgaaaagttaattgcacaaacctttgctttgaccccaaatacgcttgctagtgcccttccctgcagcttcccagacaatcagcagggtccatgggggcagggcctgggcacagcaatgccctgcttcctgtctgcatccataagaggcccctccacaccgaggctgctttaggttagccaaccaggtgcaggggaggccccatgcaggtgccattataccaacagtgagcaagaaatcagaaaaaagaggactgccttatgttgagaactgaccagagattgtgctgggccagtgtcactaggagggagaaacagatgatgcaggtcgggatgaggcccctcccagggcttggacactgtccactccctgctgccttagctgccgttgcatagtgtcccctcctgtgcctgggagcttctagcccaggtgtggtgttctcacccacccctgcagacttacagaacttgtaaatagacagcaccttgagatttcatcactttatgcagatttcccacttgggtcgttggggacagggtcttggcctaacagccgtcctctgacatccacaggctcccaccacaccacgattgcagtcatcggggaacttcttttggtgtcaggaatgattggcttaaattaacatttgtttgcaagatcaattattttttagcatatagtttctctccaaagaagcaactaggtctttaaagatgtcccagtgcttctgttagatttttgactcttacctgcataatattccaaagcactcagatcaaaataagacttttcccagcaagtagactca

SEQ ID NO: 382005 - DNA, 365 bp, Homo sapiens
ttattttcctacctaaaggattatttttagagaatgtgccaagtgattatatctctcatttttgtagatggttacagtcatcctcattttacagatttcctggaggctaaatcaggagcagcattaccatttctgattccttagtctagtgttacatattctgtcttgcctggaaattttaataattacagctcagcactttgtggttgagaagagggctgaagattcattcacttgatggtgaggatgtctaggaacctagtcctttcactttgaatgtgttagtgtactcaggtaagaaacaccactaacagtttagtggtgttcactgaactattcaaggaatccagtcacaagaagagcag

SEQ ID NO: 382006 - DNA, 347 bp, Homo sapiens
gagcactgcagtattcactacatgaagtatattttgcactgtggacacaaattagaaaaattgcaagtagtggtatattgtaattggcatgcactatatgagcagagtcaatgtgtctccttgtagaatattctctgatgatactcactattatcccctctctgctaagctttgttctgtgtctgaagggcataaagcatggaaactacatttttcagactccattaccagaaggatatggttggatttcagcaatgagtgggctttgcataaaatttggaagacgaaagagaagaaaaacctggctgctgcaggttggaacactggcaacaatagatacggagttt

SEQ ID NO: 382007 - DNA, 777 bp, Homo sapiens
ggtcttaaactcctggtttcaagtgatcctcctgccttagaccctcaaagtgctgggattacaggcctgtgccagcacacctggccccccgattcttcaaaagctttcagagaaagcattgtagaagacatgactttgtgactgtatgtttcatctcatcctacatcactaggaaggctcattcttaagaagtcatgccccatggaaaaggggatgaagacaaatcagaaaagggcaaagggaagtcacagcaaaaaaagggacagtataatcctggaaccttattaaagtcacacaactgctgcttcaattagagcaattcgtttggcaaacaccgcttgaaccctttcaattgtatgttggctcacctgtaatgtctggagcagtctatagactaggttttctagagtttctgaagcatcttccaattacaacggcaatctgacacatttctgaattgcagtctgaatccagtgttcatgtgaaccttttgtgtagtccacatcagcaggcacaaaagttgtttatatataagttgctatgatttctccagaagtttacataagtcgtctagtttcagcttgcaaggtttaatctatccatcttacaaaagactaatatccagaatctacaagaaacttaaacaaatttacaagaaaaaaacaaacaactccatcaaaaagtgtgcaaagcacaggaacagacacttctcaaaataagacatttatgtgaccaacaaacatatgaaaaaaagcccatcatcactggtcattagag

SEQ ID NO: 382008 - DNA, 461 bp, Homo sapiens
aggcattgcccaagggatggctgggtcctgagtacaggggacccgggggtacaagtagggtgagagtggggcccaagccacccctcaaagacttgggctttgtctcggcctcttgggcttggatagagaacagtgcccagtgtgactcccccaaatatctgacctcttcgtcctgctctgcctgaatggatgtgtgaccttgagcaaatcactgccccttcctgagactcagttttctcacctataaaatgagaacaataaaccccaccctgcccacctcccagggctgctgccaggtcagaggtgaagaagggctttgcacctggtgaagtaactaacccaaggtctggctttcattctacactgtcgactgcatctgcagccaaagtctggggactctgcaggtgggacttggtccagaggggactggcaaagatgctttcagagctcccctcccaccc

SEQ ID NO: 382009 - DNA, 134 bp, Homo sapiens
ttcttttagcaattcgtttctgtctccttaaaaaaaaagaagaagaccaggaaaggtggcttatgcctgtatcctagcactttgggaggccgaggcaggaggattgcttgaggccaggagttagagaccatcct

SEQ ID NO: 382010 - DNA, 1019 bp, Homo sapiens
gatggggtcagacaggagggaggcaaggaacagagccaagggcagaggtgggacagtgggctgggaggtggcgaggaggccctttattgaggggccagcttagatcccccagccccaaggtcctctgtcctccccctcccccaaaagctttgtcccagccccctacccactgggacctctgtttgtagtcagagtttgtttggctacttcctttgcaacccccacccccaacctttttctgcatggtagatgaaaaattgaaagtacctctgattggtccctttccacaaccaatgaggctggtcatgggccaagtcttcatttgcataggagtataactttgtaacttcacttcagccttttcccaatcaatcagagatttgcatagggtgtaactttgaaacttgcttcagcctctgataggtcccctccctcaaccaatcagactgattgtgggcactacttcatttacaagggtgtacatcaagtaaccaatgggaaacctctagaggatatttaacccccaaaaaattcggtaaccaggctcttgaaccacttgctcaagccactcccaccctgtgaagtgtaccttcattttcaataaatctctgcttttgttgcctcattcaaaaaaaaaacaaaaaaaagaacacaccgaaaaaaagaaaaagaaaacacacccgaacaaagacagaagggagggagcggccaaagaaaacacacaagagaggggcagaaagaggggtgcggccgcgacaccacagagattgtgagtaagaaactaacggggaccgccacccatctgagaggcgtcaagcggcacgatagttcacgcacgcagaagaaagccaagaccagcgacgatgagaaatacagtagaacaaggacaggggagctagaacagaaagagggggaaccagaagggagagaaacatctgtgcagaagcaggagcgcgaacaacactaatgcgtggtggaggagaaagaagagggcggcgacactacgtcgtacgagaaga

SEQ ID NO: 382011 - DNA, 211 bp, Homo sapiens
accaggtcagggcaaagagtggggggtgcacgttcaagaatcttgagggctgttggagaagatctgaggacagtgccacagaaccatccttttctgattcagtcccccgaagcactttgctcatgtgggatgagtggacctttcaggctggaaagtggggagctgggcctgggtgacatggcaagaacctgtctctacaaaaaatacaaaa

SEQ ID NO: 382012 - DNA, 374 bp, Homo sapiens
tgtggttgtgctccaataaaagtttatttatggacatagaaatttaggtctcatatcaggctttgaagaaaattaaagaaaggaatatttttgtccttttatgaaacagtaaattttgattgaattataaatggatctactgacaactcattttaaaatttatttccaataagcaagacattttagaaactctgatttagctttcttttatttgtattttatgttttttctggttcatgttttgccccctatattgattatagctaatagcctaatattaatatattttattgaggattaggttaatattaattgagtggcccaaatgatggggtgtctgtgctgagtgtttctgataaggcagtcaagtatag

SEQ ID NO: 382013 - DNA, 350 bp, Homo sapiens
ataggagaaaaaccgccctatggtgggaggtgagacatgtttgcagtaatgctgctttgttattctttactccactgagatgtttgggtggagagaaacataaatctggcctacatgcacgtccaggcatagtaccttcccttgaacttaattatgatatagattcttttgctcacatgttttttgttgaccttctccttattatcaccctgctctcctactacattcctttttgctgaaataatgaaaataataatcaataaaaactgagggaactcagaggccggtgccggtgcaggtccttggtgtgctgagtgccggtctcctgggcccactattgtttctctata

SEQ ID NO: 382014 - DNA, 1720 bp, Homo sapiens
  misc_feature (1714)..(1716): n is a, c, g, or t
  misc_feature (1718)..(1720): n is a, c, g, or t
atgctgggggaggggctggcggcctcgacggcagctgcggaactaggccgagggacaaaggctaagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382015 - DNA, 1046 bp, Homo sapiens
  misc_feature (1040)..(1042): n is a, c, g, or t
  misc_feature (1044)..(1046): n is a, c, g, or t
acaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaaatgggtatgctgtgtgtgggcagtggttggctttaacactagtcatcatgtgtaaggtgatttgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382016 - DNA, 443 bp, Homo sapiens
tttttcccgcgcgcggacactgtccccgcacggtggtccctcgttggtgcgtggcctgacatccggctggaggcctcgggtgctccgaaagcggtaccttcgggggcccccccgcacccattggtatgcacttcccgcttgttggagtggagggcttttccccaggacctgtcctcccttttcttagctccttgggcattctcttcctgagggtcacatgattttatcctcgagaaggcttcttttgactcatttccacctcctttcctcccaaatcctttgaatccccaatgtttgttttccgtgggtttttgcatctctcctccttcttagtgtgggttgtctcttcatgaagaaccagcggaactcaaaactgctgttcaagaaacctcttcaagacttttgacttagaacctgctatattatcaagcttacctactgtt

SEQ ID NO: 382017 - DNA, 2401 bp, Homo sapiens
  misc_feature (2395)..(2397): n is a, c, g, or t
  misc_feature (2399)..(2401): n is a, c, g, or t
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382018 - DNA, 3171 bp, Homo sapiens
  misc_feature (3165)..(3167): n is a, c, g, or t
  misc_feature (3169)..(3171): n is a, c, g, or t
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagagccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382019 - DNA, 1689 bp, Homo sapiens
  misc_feature (1683)..(1685): n is a, c, g, or t
  misc_feature (1687)..(1689): n is a, c, g, or t
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcgggtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382020 - DNA, 1679 bp, Homo sapiens
  misc_feature (1673)..(1675): n is a, c, g, or t
  misc_feature (1677)..(1679): n is a, c, g, or t
agatgggatctcttatgttgcccaggctggtcttgaattcctcctggtctcaagcgatcttcccacttcggcctcccaaagtgctgggatatagacgggagccattgtgcccgacctggcagtcgtctactaagagctttggtaactcattagcctcgtggctctgagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382021 - DNA, 1891 bp, Homo sapiens
  misc_feature (1790)..(1790): n is a, c, g, or t
  misc_feature (1801)..(1801): n is a, c, g, or t
  misc_feature (1806)..(1806): n is a, c, g, or t
  misc_feature (1814)..(1814): n is a, c, g, or t
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgaggttttgggncgtgggccccnggcgngaaaccgncaacggggggggcccagaccccccaggcggggccttttagaacccccctggcccgaccgagagggtgttctccacca

SEQ ID NO: 382022 - DNA, 2264 bp, Homo sapiens
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagagccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaataaaagcaggcatgtcatgagtgggtccgcgtataaagtgcagattgccttagagtccacacagagttagatcctctct

SEQ ID NO: 382023 - DNA, 1643 bp, Homo sapiens
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagttttggggggaggaacttttttggggtctggtgggtttttactgggtgggccacattttgaagaaaaacctttaaagggcacctcgtggagaagggacccaagcggattaacttttctcccgatatattttggggggggccttatc

SEQ ID NO: 382024 - DNA, 950 bp, Homo sapiens
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgcgtaagtgttccgtggggcgccctcccggcccgccctgcccccccttccggcccaccctgt

SEQ ID NO: 382025 - DNA, 1035 bp, Homo sapiens
  misc_feature (1029)..(1031): n is a, c, g, or t
  misc_feature (1033)..(1035): n is a, c, g, or t
gtgctcgcttcggcagcacatatactaaaatggaacgatacagagaagattagcatggcccctgcgcaagggatgacacgcaaattcgtgaagcgttccatattttgttctgttgggctttgttgctgttggtttagcaatgggattttttttcccccatcacagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382026 - DNA, 2544 bp, Homo sapiens
  misc_feature (2538)..(2540): n is a, c, g, or t
  misc_feature (2542)..(2544): n is a, c, g, or t
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382027 - DNA, 1777 bp, Homo sapiens
  misc_feature (1771)..(1773): n is a, c, g, or t
  misc_feature (1775)..(1777): n is a, c, g, or t
tttttcccgcgcgcggacactgtccccgcacggtggtccctcgttggtgcgtggcctgacatccggctggaggcctcgggtgctccgaaagcggtaccttcgggggcccccccgcacccattgtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382028 - DNA, 1634 bp, Homo sapiens
  misc_feature (1628)..(1630): n is a, c, g, or t
  misc_feature (1632)..(1634): n is a, c, g, or t
tttttcccgcgcgcggacactgtccccgcacggtggtccctcgttggtgcgtggcctgacatccggctggaggcctcgggtgctccgaaagcggtaccttcgggggcccccccgcacccattgtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaattaattgggcaggttaattgtgtacctgaaacttaacaagcagtttttggaagggcaaannnannn

SEQ ID NO: 382029 - DNA, 2411 bp, Homo sapiens
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagagccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgagggcacgaggcgggatcgactgggctcttacagcggccccacctcggtctcccgccagcgcgtcgaaagcc

SEQ ID NO: 382030 - DNA, 1577 bp, Homo sapiens
atgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagcgggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagccgagatcgcgccactgcactccaacgtgggcgacagagtgagact

SEQ ID NO: 382031 - DNA, 770 bp, Homo sapiens
cacagtcgtccttagtttatgcctttagagtccccatcaatcacccttcccactctgaactgtagagaggtacacagcacagtgagttgacttgatcaacatctggtcgagtgtctgggaaatggcagatctaggccttgagccctggtagagctacctcgcttcattcccagcaccccagtaccttactgcctccacctcacccccgtgctccctccttggctgagcgtgagaacagtggcaaaaaaaacaacataaatctaagtctctacatcctcattagatcctagagtcagctgatggtgcccaaattatcatcacaacaatataacgtaacataacataacacaaccaccacgaccaccatttacagttcatgtgaaataggagtgaaccggaaccacaagctgacttggccaagaaccagctttagcattaggatgtcagagagctcagctgccacctgtgagactgaggggaggcagtggagggttctgatggtgagacccaggtatgtgtgtctcagtggaacctccagaaagctcaaggaattcatggcactcggagacatgtagttgggtggtttgcccattgtttagttattgtgcatgtaaatccttttcttgcagaggtggaaatcagcttctaaggagatggagtcaaagtcaagcaacagaggccagaggggaggaaaatcttgcagacggtttgggaacaggggatcttgcttgaaattttttggggcaaactgattaactggcagcaagcaa

SEQ ID NO: 382032 - DNA, 503 bp, Homo sapiens
cacagtcgtccttagtttatgcctttagagtccccatcaatcacccttcccactctgaactgtagagaggtacacagcacagtgagttgacttgatcaacatctggtcgagtgtctgggaaatggcagatctaggccttgagccctggtagagctacctcgcttcattcccagcaccccagtaccttactgcctccacctcacccccgtgctccctccttggctgagcgtgagaacagtggcaaaaaaaacaacataaatctaagtctctacatcctcattagatcctagagtcagctgatggtgcccaaattatcatcacaacaatataacgtaacataacataacacaaccaccacgaccctactactatctcgcacctgaaacaagctaacatgactaacacccttaattccatccaccctcctctccctaggaggcctgccccgctaaccggctttttgccaaatgggccattatcgagaattcacaaaaacaatagcc

SEQ ID NO: 382033 - DNA, 2012 bp, Homo sapiens
cctgtgccttcgtcctttcctcctttgtcctcagctttcccgcctcctcctttcagagcccaccttcggcattttcctgccctacagccctgacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382034 - DNA, 2014 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagaggggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382035 - DNA, 1968 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaaggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382036 - DNA, 2097 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggcccacagccgtaaccggtgtaacaccattcgtctctttttcttttctttgtt

SEQ ID NO: 382037 - DNA, 572 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagtaaggcacaggaggctgctccaccatctctcctgcccggctgatccgaaacacttttctctgcttcctcccgtcacagagcggtgaccccgagacactccaggtctcaccagtcttttcccactggtcgaattcacctgccatctgggaggctgggggtcagggtgcctggggcaggtgaatgagcagcacccaggccaaacagcttgatctgctcagcagaggggctatttgcagagatggtggatcctgtctgcgtctgcctgttccccctagttctaaccatgtaagattttctaattcagacccctcgttcttttgtttgtttgtttgtttgtttgtttgatacagagttgcactctagcctgggtgacagagcgagactccatctc

SEQ ID NO: 382038 - DNA, 381 bp, Homo sapiens
ccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaacacgcctacgaaaacagctcctctcctggcacatctgccaacactg

SEQ ID NO: 382039 - DNA, 2101 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382040 - DNA, 1774 bp, Homo sapiens
taggctgtggaagacgggtaggctgtggaagacgggtaggctgtggaagacgggtaggctgtggaagacgggtaggcgtggaagacgggttggaaatgttggcacaaatggccttttctggagaagaggctgccctcccgtgggagccacgcgcagtcacctcaggtccctaggcggtgtcgcctgcacgccgagctccgcgtggtggtggggagaacaggaatgagcactctttaatgtcatcatgatctcctgtatgagcgggcccgcccccagaatgtcgtgctgctgcctgtgggtgcgggggccgccgtgcgcccccgccagccccgtgtgccccctgtcacctcaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagaggggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382041 - DNA, 1667 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtcccgtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382042 - DNA, 815 bp, Homo sapiens
ggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaaca

SEQ ID NO: 382043 - DNA, 2106 bp, Homo sapiens
  misc_feature (895)..(896): n is a, c, g, or t
  misc_feature (900)..(901): n is a, c, g, or t
  misc_feature (904)..(905): n is a, c, g, or t
  misc_feature (907)..(907): n is a, c, g, or t
  misc_feature (2006)..(2006): n is a, c, g, or t
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagnngggnncgnngnagccaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggggcttgctcaccaccttctccctggagagggcagaagaggtcacacgcagagactgctactacatcttantcacctgccaaggcttggtggccaacacccagaggaacaaattaaggaccgggaattaattcccaggggctccctggtgcccaaaggacaagagcttcca

SEQ ID NO: 382044 - DNA, 616 bp, Homo sapiens
tcaccctccccctcctcggccagtcagtgatccagggccctagtgctcaggctagatcagcaggtgggattccaagggagggcagggatgggaggccctgcacagtgaccccaggcctcaccctggactccaggggatagcaggtcttcagatgtggggggcacactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccgacatcctcacgaggatctctgcattatgtagtctagtctaggagcaatatatgc

SEQ ID NO: 382045 - DNA, 2694 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382046 - DNA, 2422 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgagctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382047 - DNA, 2212 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382048 - DNA, 2237 bp, Homo sapiens
  misc_feature (1951)..(1952): n is a, c, g, or t
  misc_feature (1956)..(1956): n is a, c, g, or t
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctggcnngggntgagggcaaccttgccccccgcagccaaagaaatgccacttggccccctcccaaggacacgaggcacgggattaacacacagaagagccaaaatggcacaaaaggaacacaacagggggggggggaattattaaaaaagacggggaaaaacccttccgcaaaatggggccaaaaccccaaaaggggggggggacccacacagaaaggggaccaaaagggagcaccaaagatggcaaaaccaaaaaaaagccccgtttgtgggagaaacccccaaaggggaa

SEQ ID NO: 382049 - DNA, 830 bp, Homo sapiens
tcaccctccccctcctcggccagtcagtgatccagggccctagtgctcaggctagatcagcaggtgggattccaagggagggcagggatgggaggccctgcacagtgaccccaggcctcaccctggactccaggggatagcaggtcttcagatgtggggggcacactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382050 - DNA, 2455 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacacagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgacggcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 382051 - DNA, 1202 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctggctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382052 - DNA, 1787 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382053 - DNA, 4151 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcctttccttggcctgatccttgtctgccttcacttccctaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacacagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgacggcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 382054 - DNA, 2018 bp, Homo sapiens
ctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcctttccttggcctgatccttgtctgccttcacttccctaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgtttttttttttcccccttcactctaatggactgttccagggaagggatgggggcagcagctgcttcggatccacactgtatctgtgtcatccccacatgggtcctcataaaggattattcaatgga

SEQ ID NO: 382055 - DNA, 447 bp, Homo sapiens
gtatttgcatgtaacctacatacttctttctgtatatgttcagtcatctctagaatacttaaaattcctaatacaatgtcagtgctatatagtacttataatacctaatgcagtgtaaatgctctgtaaatagttgttatactgtatttttcaaattcatatttttttaatttttttctgaatatttttgatctatcattggttgaactcatgaatgcagtacagaggaccgacagtatagctgtctttatcccagtcctgcagcgtttttgattactgtgggtttgtagtaagtttgaaatcaggaagtgtgagttattcaactctgttctttttcaagattgttttggctgttaagggtcccctgcgattccatgtggatttcagaattgatttttctatttctgtagaaaacatggggatattaatagggtttgtatgtattga

SEQ ID NO: 382056 - DNA, 869 bp, Homo sapiens
  misc_feature (100)..(100): n is a, c, g, or t
  misc_feature (102)..(102): n is a, c, g, or t
gggagtgttgtgctgttggtgtgttagtttgtgtgtgtttgtctcgtgtgcgtgttgtgctgtgtctatgcttgtgtgtttgtgtttctttgttgtatananaacagttgaggtataacacgatagaacagcgatccatttcggggttcttctccgcacttgagcacttggccggactcccgagtggagtcgtgctcactcaagctattgtacttggacatcggtacagccatgctgactgcccgtcttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgaggtcaggagtttgagaccagcttggccaacatagtgaaagcctgtctccacaaaaaataagaaaattagctgggttgatgacacgtgcctgtagtcccagccactcggaaggccgaggcgggaggatcacccgagcccagggaggccgagtctagtgaacggtgattgcaccacggtacccaagcctgggtgacagagtgagaccctcatttcaaaaaaaataaaaaagaacctgtcagctactcacctggattt

SEQ ID NO: 382057 - DNA, 750 bp, Homo sapiens
cctgctagaaaagcctccccattcctgggagtactcctccgccacctggaggtctgttgcccggaccccccggagaggtcgctgacaagactagcacattgcacttggcagctgtaccagccatccggactgcctcgttgtgtcgatacagagtataccccacagccagtgctagcatattggaagagtgatttaataaagctggcaaccttgacgctatgccaccagtccaaccttacttgcctcatttaccatttccattattgtggcagccctccattccgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgaggtcaggagtttgagaccagcttggccaacatagtgaaagcctgtctccacaaaaaataagaaaattagctgggttgatgacacgtgcctgtagtcccagccactcggaaggccgaggcgggaggatcacccgagcccagggaggccgagtctagtgaacggtgattgcaccacggtacccaagcctgggtgacagagtgagaccctcatttcaaaaaaaataaaaaagaacctgtcagctactcacctggattt

SEQ ID NO: 382058 - DNA, 547 bp, Homo sapiens
tattatccccttctcttcctggtttttgccccctcactccattctttttacccaaacaccacagaattttaacccgaacggccaggtaggatggcccacgcccgtaatcatagcaccccgggatcacctgaggtcaggagttcgagaccagcctgaccaacatggtgaaaccccatctctactaaaaatacaaaaattagctggatgtagtggtacgtgcctgtaatcccagctatctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggc

SEQ ID NO: 382059 - DNA, 267 bp, Homo sapiens
gtcgactcaattggtatgaataacagcaagagtttagaataatactgaatacctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgat

SEQ ID NO: 382060 - DNA, 8101 bp, Homo sapiens
tgtattacactgacggttgcaaagtgacacttttaaaaattctgtcattccttctacatttactagctggcattatttcattgaagaagaactcctcctctttctttttcaatatcactcttcgtggattcttctttatattaaatatgttgtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382061 - DNA, 8466 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382062 - DNA, 7788 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcacagcagtgcacaacctcgacattgcaagtctgatcacagactctactaggtccccacggcgcatgaagagtgcagcatgcaa

SEQ ID NO: 382063 - DNA, 6485 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggtaaatattagtctggtgattttttttttcttctcttttgagacggagtttccctcttgttgccaggctggagtccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382064 - DNA, 5925 bp, Homo sapiens
  misc_feature (5900)..(5900): n is a, c, g, or t
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaattgagcaagactgcgtctccaccaanaaaaaaatccaggcatggtgactac

SEQ ID NO: 382065 - DNA, 4963 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctcaaaaa

SEQ ID NO: 382066 - DNA, 5164 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggc

SEQ ID NO: 382067 - DNA, 4877 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccag

SEQ ID NO: 382068 - DNA, 6078 bp, Homo sapiens
aggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382069 - DNA, 6163 bp, Homo sapiens
tgtattacactgacggttgcaaagtgacacttttaaaaattctgtcattccttctacatttactagctggcattatttcattgaagaagaactcctcctctttctttttcaatatcactcttcgtggattcttctttatattaaatatgttgtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382070 - DNA, 3287 bp, Homo sapiens
  misc_feature (448)..(448): n is a, c, g, or t
taacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctaganccaatcccccgcaagatagcaaggatgactgaactatgcaagaatcaaagcagtgttactcagcatacaattcctgtgttcaaaaaagttacctcatcaggtacatgagacttataatgaataaaaggaatcttctaaaacagatatgttgtcaccgaaggtcattacaagaagatgaagaaggattctcaaggtaaatattagtctggtgattcttatgatcttctcgagatggagccctcttgttgccaggctggagtgcaatgacacgatctcggctcacggcaacctccacctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382071 - DNA, 3372 bp, Homo sapiens
  misc_feature (44)..(44): n is a, c, g, or t
tggcgttctagaggatacccgttaggtcggacccacctattaantcctcttccaatatgctagcacggcctgtggggaaaagtaatacatcatgtaatcgaacaaaagacagaggcaagctccaggaatgggcactgtaaacaggacttgtcccagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382072 - DNA, 2265 bp, Homo sapiens
agacggagtttccctcttgttgccaggctggagtgcagtgacagaggatgacactgcactccagcgtaagcaacagagggcaatcccgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacaatatgttgtcaccgaaggtcattacaagaagatgaagaaggattctcaaggtaaatattagtctggtgattttttttttcttctcttttgagacggagtttccctcttgttgccaggctggagtccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382073 - DNA, 1721 bp, Homo sapiens
  misc_feature (17)..(17): n is a, c, g, or t
  misc_feature (22)..(22): n is a, c, g, or t
  misc_feature (30)..(30): n is a, c, g, or t
  misc_feature (35)..(35): n is a, c, g, or t
ggtcatagctgattctngaggntacaaccncgagncgaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382074 - DNA, 1514 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttatatgaagaaattatcactgtgtgctatgcatcaagcagagatcacagtatactagtgtgtggatgttaatgtta

SEQ ID NO: 382075 - DNA, 1354 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtg

SEQ ID NO: 382076 - DNA, 944 bp, Homo sapiens
agacggagtttccctcttgttgccaggctggagtgcagtgacagaggatgacactgcactccagcgtaagcaacagagggcaatcccgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacaatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggc

SEQ ID NO: 382077 - DNA, 700 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtatttaatttctttaataagagctccctggttctacagcactgccttgcgttgc

SEQ ID NO: 382078 - DNA, 336 bp, Homo sapiens
ctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttat

SEQ ID NO: 382079 - DNA, 8360 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382080 - DNA, 8016 bp, Homo sapiens
aggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382081 - DNA, 8282 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382082 - DNA, 5593 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382083 - DNA, 5488 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382084 - DNA, 7140 bp, Homo sapiens
actatgcatatcttatttattctcatcaagttactcctcattccgactctccctgctgagtcagaagaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382085 - DNA, 4858 bp, Homo sapiens
tccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctcaaaaa

SEQ ID NO: 382086 - DNA, 5303 bp, Homo sapiens
gctgcggtactctaaggatcagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgatataatagcaaaatttctcccacccaaaactatgtcaacaattggatgtactcatcaagtcacccttactctgccactaatttatttccttggtgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggctcaagggatcctcccgcctcagcttcctgagtggctgggactacaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccacggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaattgtgattccgatgaagcctgccagagaaataaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcagg

SEQ ID NO: 382087 - DNA, 542 bp, Homo sapiens
ggtttcatcatgttggccaggatggtctcgatctcttgaccttgtgatctgcccacctcagcctcccacagtgttgggattacaggcgtgagccactgtgcccggctatctttacaatcttttatattgacttgacagtttaattctggattcacacacaattaagtttgatcttgcctagaggataggatctgtcacttgtattggcacattggcagtggccctttggaataccaaacttgtacatcagatggttctgtgtggtgtcagtcagtgtgccattgaatggtgtggtcagagatggatgttatctatttctacagatcacctcagtcgtcgtggcccacaagacttttctagcccatgttcagcccaagatctccaatgtcctcttcacttctcatttcagcccgtgtttccacttcactcgtgctttcttcagttctgctgaagttctgtcctttacttgtttataatttgatatctttgagactttaaatgtggcagtgagttgcaatgagaaaaggaggtggggaaagtga

SEQ ID NO: 382088 - DNA, 300 bp, Homo sapiens
gtatgggttaccaggatcagcagtttgcatacaaccaacttcaaaaacgtttatagtcagcatctagaaatcctgaaagctaagttaacattagatctgataatcaattgtctgtgtctccaaaatgcaatacagagataagaatgcacaattgattctagagcacacaatctggacctgggaactgtacaaacactgaggttaaactcagaataacagctgttaaatctatagatcttaacagtggaaattctgcaatcccccaattccatttgatatatgcttcatcattccactggc

SEQ ID NO: 382089 - DNA, 393 bp, Homo sapiens
taaatatagttaaactattttcaaagttttgagaaacctaaaacaaaaataaattttcttcttatatttattccataacagtcgaaattcagagacacattttaggaatcaagttagtttttttgttttttgttttttttgtttttttgttttttgtttttttgagacagggtcttgctctgtcgcccaggctgcaggctggaatgcagtagtgcattctcagctcacagcaacctctccacctaccaggctcaagtgatcctcccatctcagcctcttcatagaaccacaggcgcgtgccaccaagcccagctaatttttgtactttttgtagagatgggtttcactgtgttgccaaagctggtctcggaactccaagcaacctgcctgcct

SEQ ID NO: 382090 - DNA, 229 bp, Homo sapiens
acaatatataaaaataaaaagtcaacacaaatcgcttttagataccctttcacgaatctaataggttgtcacacactgtacaaaactatgtgagaacgtatactacttctcagccacaactactatttttagatattcataaaataacctctgtattgtgttttcacattgacccattcagttctgtccaatcttataattctgattaaatgttctggcctcaaaacta

SEQ ID NO: 382091 - DNA, 757 bp, Homo sapiens
gtggtgctgacaaagcttggaagagcctgcaggtgctgctgcgtggcatagccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttccaaaaaaaaaaact

SEQ ID NO: 382092 - DNA, 717 bp, Homo sapiens
ccagccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcgaaacaagttttcattttccacaaattttaaatggtgcagttttctaacgtgataagacacatagtggtgttacttagtttttattttttaatttagggccaccattttaaaaacaaa

SEQ ID NO: 382093 - DNA, 6994 bp, Homo sapiens
tgcccctactcaggtgtcctggcctctaagccctcaacccctgggtatcccgaatttccgaaatctctgcccctagctattttgaccctgggggtcttgccatgattggggcctggagccacatccatggctctgctccggacgcccctgggttaagagcagcagcctctcaagccactctgtggcaggagctccaggtggaggtaaaagctcaccaggggcaggtgcaacgggtgctgagttctgggcggagcctggcagcctcagggcacccccaagcccaacacatcgtggagcagtgccaggagctggaaggccactgggcagagctggagagggcatgtgaagcgcgggcccagtgtctgcagcaggctgtcactttccagcagtactttctggatgtgtcagagctggagggctgggtggaggagaagcggccgctggtgagcagtcgggactatggcagagacgaggcagccaccctcaggctcattaacaagcaccaggctctacaggaggaactagccatttactggagctccatggaggagcttgaccagacggcccaaaccctcactggccccgaagtccctgagcagcagcgtgtggtgcaggagaggctccgggagcagctgcgggcactgcaggagttggcggccacacgggaccgggaactggaggggaccctgaggctgcatgagttcctgagggaggctgaggacctgcagggctggctggcaagccagaagcaggcagccaaaggaggggagagcctgggagaggaccccgagcacgccctgcacctctgcaccaagtttgcaaagtttcagcaccaagtggagatgggcagccagcgggtggccgcctgccggctgctggcggagagcctgctagagcgtgggcacagtgctggccccatggtccgtcagaggcagcaggatctgcagaccgcctggtcggagctgtgggagctgacccaggcccgaggccacgcgctccgagacaccgagaccaccctcagagttcacagagatctcttggaagtcctcacccaggtccaggagaaagccacgagcctccccaacaatgtggcacgggacctgtgtgggctggaggcgcagctgagaagccaccaggggctggagcgagaactcgtgggcaccgagcggcagctgcaggaactgctggagactgcaggcagggtgcagaagctgtgtccggggcctcaggcccatgcggtgcagcagaggcagcaagctgtgacgcaggcgtgggcagtgctgcagcgacgcatggagcagcgcagggcccagctggagcgggcacgcctcctggcccgcttccgcacggcggtgcgtgactatgcctcctgggcagcccgcgtgcgccaggacctgcaggtggaggagagttcgcaagagcctagcagtggcccgctgaagctcagtgcccaccagtggctccgggcggagctggaggcccgggagaagctgtggcagcaggccacccagctggggcagcaggcacttcttgctgcagggacacccaccaaggaggtccaggaagagcttcgagccctgcaggaccagcgggaccaggtgtatcagacctgggcacggaagcaagagaggctgcaggccgagcagcaggagcagctcttcctcagagagtgcggccgcctggaggagatcctcgcggcccaggaggtctccctgaaaaccagtgccttggggagctcggtggaagaggtagagcagttgattcgcaagcacgaggtcttcctgaaggttctgactgcccaggacaagaaggaggcagccctgcgtgagcggctgaagacgctccggcgcccccgggtgcgggaccggcttcccatcctgctgcagcgccggatgagagtgaaggagctggcggagagccggggacacgccctgcatgcctccctgctgatggccagcttcacccaggccgcaacccaggctgaggactggatccaggcgtgggcccagcagctgaaggagccggtccctcctggggacctgagagataagctgaagcccctgctgaaacaccaggcctttgaggctgaagtccaggcccatgaggaggtcatgacctctgttgccaagaagggagaggctctcctggcacagagtcaccctcgagccggagaggtctcccagcggctgcagggcctgcggaagcactgggaggacctgaggcaggcaatggccctcaggggccaggagctggaggacaggcggaacttcctggagttcctgcagagagtggaccttgcagaggcctggatccaggagaaggaggtgaagatgaatgttggtgacctgggccaggacctggagcactgcctgcagctccgacggcggctccgcgagttccgaggaaactcggccggggacacagtgggtgatgcctgcatcaggagcatcagtgacttgtcactgcagctcaagaaccgggaccctgaggaagtcaagatcatctgccagcggcgaagccagctcaacaacaggtgggcgagtttccatggcaacttgctccggtaccagcagcagctcgaaggggccttggagatacacgtgttgtcccgagagctggacaatgtcaccaagaggattcaggagaaggaagccctgatccaggccctggactgtgggaaagatctggagagcgtgcagaggctgctgcggaaacacgaggagctggagcgggaagtgcaccccatccaggcccaggtggagtccctagagcgtgaagtgggccgcctctgccaaagaagccccgaggcagcccacggcctcaggcacaggcagcaggaggtggctgagagctggtggcagctccggagcagggcccagaagcggagggaggcgctggatgccttgcaccaagctcagaaactccaggcaatgctgcaggaattgctggtcagcgcccagaggctgcgggctcagatggacacgagccccgctcctcgcagccctgtggaagcccggcgtatgttagaagagcatcaggagtgcaaggccgagctggactcctggacagacagcatcagcctggcccgaagcactgggcagcaactgctcacagcggggcaccccttcagctccgacattcgccaggtgctggctggcttagaacaggagctgagcagcctggaaggggcctggcaggagcatcagctacagctgcagcaggccctggagctacagctgtttctgagctcagtggagaagatggaacgttggctttgcagcaaggaagactccctagccagtgagggtctatgggaccccttggcccccatggagccccttctgtggaagcacaagatgctggagtgggacctggaggtgcaggcgggaaagatcagtgctctggaggccacggcccgcggcctgcaccagggtgggcaccccgaggcccagagtgccctgggcaggtgccaggccatgcttctgaggaaggaggcgctcttcaggcaagccgggacccgccgccatcgcctggaggagctccggcagctgcaggccttcctgcaggactcccaggaggtggctgcgtggctgagggagaagaacctggtggccttggaggagggtttgctggacacagccatgctgccagcacagttacagaagcagcagaatttccaggcggagctggacgcgagcatgcaccaacagcaggagctgcagcgggagggacagaggctgctgcaggggggccacccagcctcggaggccatccaggagcgactggaggagctgggagcactctggggtgagctgcaagacaactcccagaagaaggtggccaagctccagaaggcctgtgaggccctgcgtctgcggcggagcatggaggaactggagaactggctggagcccatcgaggttgagctgagagcccccactgtgggccaggccctgcctggggtgggcgagctcctgggcacacagagggagctggaggcagcagtggacaagaaggccaggcaggctgaggcactgctgggccaggcccaggcctttgtgagggaaggccactgccttgcccaagatgtggaagagcaggcccggcggctgcttcagaggttcaagagcctgagggagcccctgcaggagcgcaggacggccctggaggcccggagcctcctcttgaagttcttcagggacgccgacgaggaaatggcctgggtgcaggagaagctgcctctggccgctgcccaggactatggccagagcctgagtgcggtgcggcacctgcaggagcagcaccagaacctggagagtgagatgagcagccacgaggctctgacccgggtggtgctgggcactgggtacaagctggtgcaggctgggcactttgccgcccacgaggtggccgcccgggtgcagcagctggagaaggccatggcccacctgcgggcagaggcggcgcggaggcggcttctgctgcagcaggctcaggaggcccagcagtttctgactgagctcctggaggcgggatcctggctggctgagcggggccatgtcctggacagcgaggacatgggccacagtgctgaagccacacaggcccttctgcggcggctggaggccaccaagagagacctggaagcgttcagcccacgcatcgagcggctgcagcagacagcagcactcctggagagcaggaagaacccagaaagccccaaggtgctagcccagctgcaggcagttcgggaggcccacgcagagctgctgcggagggcggaggccagggggcacggcctgcaggagcagctgcagctacaccagctggagcgagagaccctgctcctcgacgcctggctgaccaccaaggcggccaccgccgagtcccaggactacgggcaggacctggagggtgtcaaggtgctggaagagaagtttgatgctttcagaaaggaagtgcagagcctgggccaggccaaggtgtatgccctgaggaagttggcaggcaccctggagcggggtgcacccaggcgctatccccacatccaagcccagaggagccgcattgaggctgcttgggagaggttggaccaagcaataaaagcccgcacagagaacttggctgcagcccatgaggtccacagctttcagcaggcagcagctgagctccagggaaggatgcaggagaagacggccctgatgaagggggaggacggaggccacagcctgtcatctgtgcggaccctgcagcaacagcacaggcgcctggagagagagctggaagctatggagaaggaggtggcacggctacagacggaggcctgccgactgggccagctacatcctgcagctccggggggcctggccaaggtgcaggaggcctgggccaccctgcaggcgaaggcccaggagcgaggccagtggctggcgcaggctgcacagggccatgccttcctcgggcgctgccaggaactgctagcatgggcacaggagaggcaggagctggcgtcctccgaggagctggctgaggacgtggcgggggctgagcagctccttgggcagcatgaagagctggggcaagaaatcagggagtgccgccttcaagcccaggacctgcggcaggaaggacagcagctggtggacaacagccacttcatgtctgcggaggtgacagagtgcctgcaggagctggaagggcggctgcaggagctggaggaggcttgggccctgcgctggcaacgctgtgccgagagctggggcctgcagaagcttcggcagaggctggagcaggctgaggcctggctggcctgctgggagggactcctgctgaagcccgactatgggcactcagtgtcagatgtggagttgctgctgcacagacaccaggacttagaaaagctgctggcagcccaggaagagaagtttgcccaaatgcaaaagacagagatggaacaggagctcctgctgcagccacaggagctgaagcccgggagagctggcagctcgctgacatcctttcagtggaggccctctggacaccaggggctaggagcacagctggctgagacgagggacccccaggatgcaaagggtacccccaccatggaggggtctttggagttcaagcagcacctgctgcctggcgggaggcagcctagctcgagctcctgggacagctgccgcgggaccttgcagggcagctctctgagcctgttcctggatgagaggatggcagcggagaaagtagcttccatagccctccttgacctcacgggagcccggtgtgagaggctgcggggccgccacggcaggaaacacacattctccttaaggctgaccagtggggcagagatcctgtttgcagcaccgtccgaagagcaggctgagagctggtggcgagccctgggcagcactgcagcccagagtctgagcccaaaactcaaagccaaacctgtcagctctctgaatgagtgcacgaccaaggatgcccggcctggatgtctactcaggtctgatccctgaggtgaaccccagtgcaacaccaaacttcaggggcacaagcgaggacacatctaagggaccagaataagactcagctacaggcaaaagggctccttcccgtggctgcttcaacccagttccccaggcccagcttctggaatagacagttccttctggttagatgggtcctaccatgtggcaggaaacagccattgcctggcctccccctgcattcctgtctgggtgaagaggagacgtgttacggcagagcaggtgggcaaggccagggctaccccaggcccatgtggcctcctccttgcttggaaggggtgactctgagcacaggtagacgcagacgtgtgcagagaatgtgctcttcggaggaagaacactgatgagcgagctctgtaccagcccttgccatgtacagccaagagcctagaatgacatggcccttctcagcagtaataacagatggtctcagcgcctca

SEQ ID NO: 382094 - DNA, 444 bp, Homo sapiens
acagcaaggtgggggacttccccagtgccagtgctcagagggacccagcaccttgggaccactgcaatgaccatcatctctggccaggagccggccaggtccaccgcctgtgggcagcagctggcagaagtggtggagctgctgcagaggcatgacctgctggaggctcaagtctcggcccacggagcccatgtgagccatcttgctcagcagacagcagagctggactcctccctgggcaccagtgtggaggtgctgcaggccaaggccaggacactggcccagctccaacagagcctggtggctcttgtcagggcccggtaagagcctgccccaactcttccacctttcccagaacttttctgtaacccaaattatctcctgcccaggttaaagtactgttggcctgccagttttctccacactgaccctcacttccaaagc

SEQ ID NO: 382095 - DNA, 11723 bp, Homo sapiens
ggacaatgccgcctgtgtgccgtcaccccagcacgctggctcaaggggagggctgtggtgcagccctgctccagccttggcctctcctgatgtccctctccctccctccacagcccctgctatctgccatctccatccgtccagctgggccgcctctgtggaacccaggcatcaccaaggtttagggagccatccagcagctcctcatccccaaagtctgcagggctgatggctggtcagccccacagtccccgggagctcctcggggctgcagggcaccgcagcaggaggcccagcacagaactccgggtcccgcccagtccaagtctcaccatggactctcagtacgagacgggccacattcgcaagctacaggcccggcacatgcagatgcaggagaagactttcaccaagtggatcaataacgtcttccagtgcggccaggcgggcatcaagatccggaacctgtacacagagctggctgacggcatccacctcctgcggctgctggagctcatctcaggggaggccctgccacccccgagccggggccgcctgcgtgtgcacttcctggagaacagcagccgagctctggccttcctcagggccaaggtgccagtaccactcatcgggccagagaacatcgtggacggagaccagacactcatcctgggactcatctgggtcatcattctgcgtttccagatctcccacatctccttggacaaggaggagtttggggccagcgcagccctgctgtccaccaaggaagccctgctggtctggtgccagcggaagacagccagctacaccaacgtgaacattacagatttctcccgaagctggagcgatgggctgggcttcaatgccctcatccatgcccacaggccagacctgttggactacggctccctgcgtccagaccgcccactgcacaaccttgcttttgctttcctggtggctgagcaggagctgggcattgctcagctgctggaccccgaggacgtggcagccgcacagccagatgagcgctctatcatgacctacgtctccctctactaccactactgctcccgcctgcatcaggggcagactgtccagaggagactcactaagatcctgcttcagctccaggagacagagctgctgcagacccagtacgagcagctggtggctgaccttctacgctggattgcagagaagcagatgcagctggaggcgcgggattttccagactcgctgcccgccatgcggcagctactggcagcattcaccatcttccgcacccaggagaagccaccccggctacagcagcgaggggccgcagaggccctgctcttccggctacagacagcactccaagcccagaaccgcaggcccttcctgcctcatgagggcctgggccttgcagagctgtcccagtgctgggcagggctggagtgggcagaggctgcaaggagccaggccctgcagcagaggctactgcagctgcagcggctagaaaccctggcccggcgcttccagcgcaaggcagccctccgggagagtttccttaaggatgcagagcaggtgctagaccaggccagagccccgccagccagcctggccacagtggaggcagccgtccagaggctgggcatgctggaggctggcatcctgccccaggaggggcgcttccaggccctggctgagatcgcagacatcctccggcaggagcagtaccacagctgggcagatgtggcccgcaggcaggaggaagttaccgtgcgctggcagaggctccttcagcatctacagggacagaggaagcaggtggcagacatgcaggctgtgctgagcctgctgcaggaggtggaggctgcctcccaccagctggaggagctgcaggagccggccaggtccaccgcctgtgggcagcagctggcagaagtggtggagctgctgcagaggcatgacctgctggaggctcaagtctcggcccacggagcccatgtgagccatcttgctcagcagacagcagagctggactcctccctgggcaccagtgtggaggtgctgcaggccaaggccaggacactggcccagctccaacagagcctggtggctcttgtcagggcccggcgggccctgctggagcagaccctgcagcgggcagagttcctgcgcaactgtgaggaggaggaagcctggctgaaggagtgcggacagcgggtggggaatgcggccctgggccgggatctcagccagatcgcaggcgccctgcagaaacacaaggccctggaagctgaggtccaccgccaccaggccgtgtgcgtagatctcgtgcggaggggacgcgacctcagcgcccgcaggcccccaacgcagccggatcccggggaacgggcagaggccgttcagggagggtggcagctgctccagacccgggtggtggggcggggcgcacggctgcagacagccctgctggtcctgcagtacttcgcggacgcggcggaggcggcttcgtggctgcgcgagcggcgatcctcgctggagagagcgtcctgcggtcaggaccaggcggccgccgagaccctgctgaggcgccacgtgcggctggagcgcgtcctgcgcgccttcgcggccgagctgcggcggctggaggagcaggggcgggcggcctcggcccgggcgtcgttattcacggtgaactctgccctgagccctccaggagaaagcctgaggaacccagggccctggagtgaggcttcctgccaccctggccctggggatgcctggaagatggccctcccagctgagcctgaccctgactttgatcccaacactatactccagacacaggaccacttgagtcaggactatgagagtctgcgggccctggcacagctccgcagggcccggttggaggaggccatggccctgttcggtttctgcagttcctgtggggagctccagttgtggctggagaagcagacagtgctgctccaaagggtgcagccccaggctgacaccctggaggtcatgcagctcaaatatgagaacttcctcactgccctggctgtgggaaagggcctctgggctgaggtcagcagctctgctgagcaactgaggcagagatatcctgggaactccacacaaatccaacgacagcaggaggaactgagccagaggtgggggcagctggaggccctgaagagggagaaggccgtgcagctggcacacagtgtggaagtgtgcagttttctgcaggagtgtggacccacacaggtccagctgcgagacgtgctcctccagctggaggccctgcagccagggagctcagaggacacccgccacgccctgcagctggcccagaagaagaccctggtgctggagaggagggtctacttcctccaaagtgtggtcgtaaaggtcgaggagccaggctacgcagagagccagcctctgcaaggacaggtggagacactgcaggggctgctgaagcaagtacaggaacaagtggcccaacgggcccggcgccaggctgagactcaggcccggcagagcttcctgcaagagagccagcaactgctactgtgggcagagagtgtccaggctcagctgcgcagcaaggaggtgtcagtggatgtggcctcggctcagcggctgctgagggagcatcaagacctgctggaggagatccacctgtggcaggagaggctgcagcagctggacgctcagagccagcccatggcagccttggactgcccagactcccaagaggtgcccaacactctgagggtcctggggcagcagggccaggagctgaaggttttgtgggagcagaggcagcagtggctgcaagaggggctggagctgcagaagtttggccgagaagtggatggtttcactgccacctgtgccaaccaccaggcctggctgcacctggacaaccttggggaggacgtgagggaggccctgagcctgctgcagcagcaccgggagtttgggcggctcctgagcaccctggggcctcgggcagaggctctgcgggcacacggcgagaagctggttcagagccagcacccagctgcacacacggtcagagagcagctgcagagtatccaggcacagtggaccaggctccaggggaggagtgagcagaggaggaggcagttgctggcttccctccagctccaggagtggaagcaggatgtggcagagctgatgcagtggatggaagagaaggggctgatggctgcgcatgagccctccggagcgcgcagaaacatcctgcagacactcaagcggcacgaagcagctgagagcgagctactcgccacccgcagacacgtggaggccctgcagcaggttgggagagagctgttgagtaggaggccctgtggccaggaggacatacagaccaggcttcaaggcctgagaagcaagtgggaagctttgaaccgcaagatgactgagcgtggggacgagctccagcaggctggacagcaggagcaactcctgaggcagctgcaggatgcaaaggagcagctggagcagctcgaaggggccctacagagctcggaaacagggcaggacctgcgctccagccagaggctgcagaaacggcaccaacagctggagagtgagagccggaccctggctgccaagatggctgccctcgcctccatggcccatggcatggccgcctccccggccatcctggaagagacccagaagcacctccggaggctggagcttctgcaggggcatctggccatccggggcctgcagctgcaggcctcagtggagctgcaccagttctgccacctgagcaacatggagctctcttgggtagccgagcacatgccccatggcagccccaccagctataccgagtgcttgaatggtgcccagagccttcaccgcaagcacaaggagctccaggtggaggtaaaagctcaccaggggcaggtgcaacgggtgctgagttctgggcggagcctggcagcctcagggcacccccaagcccaacacatcgtggagcagtgccaggagctggaaggccactgggcagagctggagagggcatgtgaagcgcgggcccagtgtctgcagcaggctgtcactttccagcagtactttctggatgtgtcagagctggagggctgggtggaggagaagcggccgctggtgagcagtcgggactatggcagagacgaggcagccaccctcaggctcattaacaagcaccaggctctacaggaggaactagccatttactggagctccatggaggagcttgaccagacggcccaaaccctcactggccccgaagtccctgagcagcagcgtgtggtgcaggagaggctccgggagcagctgcgggcactgcaggagttggcggccacacgggaccgggaactggaggggaccctgaggctgcatgagttcctgagggaggctgaggacctgcagggctggctggcaagccagaagcaggcagccaaaggaggggagagcctgggagaggaccccgagcacgccctgcacctctgcaccaagtttgcaaagtttcagcaccaagtggagatgggcagccagcgggtggccgcctgccggctgctggcggagagcctgctagagcgtgggcacagtgctggccccatggtccgtcagaggcagcaggatctgcagaccgcctggtcggagctgtgggagctgacccaggcccgaggccacgcgctccgagacaccgagaccaccctcagagttcacagagatctcttggaagtcctcacccaggtccaggagaaagccacgagcctccccaacaatgtggcacgggacctgtgtgggctggaggcgcagctgagaagccaccaggggctggagcgagaactcgtgggcaccgagcggcagctgcaggaactgctggagactgcaggcagggtgcagaagctgtgtccggggcctcaggcccatgcggtgcagcagaggcagcaagctgtgacgcaggcgtgggcagtgctgcagcgacgcatggagcagcgcagggcccagctggagcgggcacgcctcctggcccgcttccgcacggcggtgcgtgactatgcctcctgggcagcccgcgtgcgccaggacctgcaggtggaggagagttcgcaagagcctagcagtggcccgctgaagctcagtgcccaccagtggctccgggcggagctggaggcccgggagaagctgtggcagcaggccacccagctggggcagcaggcacttcttgctgcagggacacccaccaaggaggtccaggaagagcttcgagccctgcaggaccagcgggaccaggtgtatcagacctgggcacggaagcaagagaggctgcaggccgagcagcaggagcagctcttcctcagagagtgcggccgcctggaggagatcctcgcggcccaggaggtctccctgaaaaccagtgccttggggagctcggtggaagaggtagagcagttgattcgcaagcacgaggtcttcctgaaggttctgactgcccaggacaagaaggaggcagccctgcgtgagcggctgaagacgctccggcgcccccgggtgcgggaccggcttcccatcctgctgcagcgccggatgagagtgaaggagctggcggagagccggggacacgccctgcatgcctccctgctgatggccagcttcacccaggccgcaacccaggctgaggactggatccaggcgtgggcccagcagctgaaggagccggtccctcctggggacctgagagataagctgaagcccctgctgaaacaccaggcctttgaggctgaagtccaggcccatgaggaggtcatgacctctgttgccaagaagggagaggctctcctggcacagagtcaccctcgagccggagaggtctcccagcggctgcagggcctgcggaagcactgggaggacctgaggcaggcaatggccctcaggggccaggagctggaggacaggcggaacttcctggagttcctgcagagagtggaccttgcagaggcctggatccaggagaaggaggtgaagatgaatgttggtgacctgggccaggacctggagcactgcctgcagctccgacggcggctccgcgagttccgaggaaactcggccggggacacagtgggtgatgcctgcatcaggagcatcagtgacttgtcactgcagctcaagaaccgggaccctgaggaagtcaagatcatctgccagcggcgaagccagctcaacaacaggtgggcgagtttccatggcaacttgctccggtaccagcagcagctcgaaggggccttggagatacacgtgttgtcccgagagctggacaatgtcaccaagaggattcaggagaaggaagccctgatccaggccctggactgtgggaaagatctggagagcgtgcagaggctgctgcggaaacacgaggagctggagcgggaagtgcaccccatccaggcccaggtggagtccctagagcgtgaagtgggccgcctctgccaaagaagccccgaggcagcccacggcctcaggcacaggcagcaggaggtggctgagagctggtggcagctccggagcagggcccagaagcggagggaggcgctggatgccttgcaccaagctcagaaactccaggcaatgctgcaggaattgctggtcagcgcccagaggctgcgggctcagatggacacgagccccgctcctcgcagccctgtggaagcccggcgtatgttagaagagcatcaggagtgcaaggccgagctggactcctggacagacagcatcagcctggcccgaagcactgggcagcaactgctcacagcggggcaccccttcagctccgacattcgccaggtgctggctggcttagaacaggagctgagcagcctggaaggggcctggcaggagcatcagctacagctgcagcaggccctggagctacagctgtttctgagctcagtggagaagatggaacgttggctttgcagcaaggaagactccctagccagtgagggtctatgggaccccttggcccccatggagccccttctgtggaagcacaagatgctggagtgggacctggaggtgcaggcgggaaagatcagtgctctggaggccacggcccgcggcctgcaccagggtgggcaccccgaggcccagagtgccctgggcaggtgccaggccatgcttctgaggaaggaggcgctcttcaggcaagccgggacccgccgccatcgcctggaggagctccggcagctgcaggccttcctgcaggactcccaggaggtggctgcgtggctgagggagaagaacctggtggccttggaggagggtttgctggacacagccatgctgccagcacagttacagaagcagcagaatttccaggcggagctggacgcgagcatgcaccaacagcaggagctgcagcgggagggacagaggctgctgcaggggggccacccagcctcggaggccatccaggagcgactggaggagctgggagcactctggggtgagctgcaagacaactcccagaagaaggtggccaagctccagaaggcctgtgaggccctgcgtctgcggcggagcatggaggaactggagaactggctggagcccatcgaggttgagctgagagcccccactgtgggccaggccctgcctggggtgggcgagctcctgggcacacagagggagctggaggcagcagtggacaagaaggccaggcaggctgaggcactgctgggccaggcccaggcctttgtgagggaaggccactgccttgcccaagatgtggaagagcaggcccggcggctgcttcagaggttcaagagcctgagggagcccctgcaggagcgcaggacggccctggaggcccggagcctcctcttgaagttcttcagggacgccgacgaggaaatggcctgggtgcaggagaagctgcctctggccgctgcccaggactatggccagagcctgagtgcggtgcggcacctgcaggagcagcaccagaacctggagagtgagatgagcagccacgaggctctgacccgggtggtgctgggcactgggtacaagctggtgcaggctgggcactttgccgcccacgaggtggccgcccgggtgcagcagctggagaaggccatggcccacctgcgggcagaggcggcgcggaggcggcttctgctgcagcaggctcaggaggcccagcagtttctgactgagctcctggaggcgggatcctggctggctgagcggggccatgtcctggacagcgaggacatgggccacagtgctgaagccacacaggcccttctgcggcggctggaggccaccaagagagacctggaagcgttcagcccacgcatcgagcggctgcagcagacagcagcactcctggagagcaggaagaacccagaaagccccaaggtgctagcccagctgcaggcagttcgggaggcccacgcagagctgctgcggagggcggaggccagggggcacggcctgcaggagcagctgcagctacaccagctggagcgagagaccctgctcctcgacgcctggctgaccaccaaggcggccaccgccgagtcccaggactacgggcaggacctggagggtgtcaaggtgctggaagagaagtttgatgctttcagaaaggaagtgcagagcctgggccaggccaaggtgtatgccctgaggaagttggcaggcaccctggagcggggtgcacccaggcgctatccccacatccaagcccagaggagccgcattgaggctgcttgggagaggttggaccaagcaataaaagcccgcacagagaacttggctgcagcccatgaggtccacagctttcagcaggcagcagctgagctccagggaaggatgcaggagaagacggccctgatgaagggggaggacggaggccacagcctgtcatctgtgcggaccctgcagcaacagcacaggcgcctggagagagagctggaagctatggagaaggaggtggcacggctacagacggaggcctgccgactgggccagctacatcctgcagctccggggggcctggccaaggtgcaggaggcctgggccaccctgcaggcgaaggcccaggagcgaggccagtggctggcgcaggctgcacagggccatgccttcctcgggcgctgccaggaactgctagcatgggcacaggagaggcaggagctggcgtcctccgaggagctggctgaggacgtggcgggggctgagcagctccttgggcagcatgaagagctggggcaagaaatcagggagtgccgccttcaagcccaggacctgcggcaggaaggacagcagctggtggacaacagccacttcatgtctgcggaggtgacagagtgcctgcaggagctggaagggcggctgcaggagctggaggaggcttgggccctgcgctggcaacgctgtgccgagagctggggcctgcagaagcttcggcagaggctggagcaggctgaggcctggctggcctgctgggagggactcctgctgaagcccgactatgggcactcagtgtcagatgtggagttgctgctgcacagacaccaggacttagaaaagctgctggcagcccaggaagagaagtttgcccaaatgcaaaagacagagatggaacaggagctcctgctgcagccacaggagctgaagcccgggagagctggcagctcgctgacatcctttcagtggaggccctctggacaccaggggctaggagcacagctggctgagacgagggacccccaggatgcaaagggtacccccaccatggaggggtctttggagttcaagcagcacctgctgcctggcgggaggcagcctagctcgagctcctgggacagctgccgcgggaccttgcagggcagctctctgagcctgttcctggatgagaggatggcagcggagaaagtagcttccatagccctccttgacctcacgggagcccggtgtgagaggctgcggggccgccacggcaggaaacacacattctccttaaggctgaccagtggggcagagatcctgtttgcagcaccgtccgaagagcaggctgagagctggtggcgagccctgggcagcactgcagcccagagtctgagcccaaaactcaaagccaaacctgtcagctctctgaatgagtgcacgaccaaggatgcccggcctggatgtctactcaggtctgatccctgaggtgaaccccagtgcaacaccaaacttcaggggcacaagcgaggacacatctaagggaccagaataagactcagctacaggcaaaagggctccttcccgtggctgcttcaacccagttccccaggcccagcttctggaatagacagttccttctggttagatgggtcctaccatgtggcaggaaacagccattgcctggcctccccctgcattcctgtctgggtgaagaggagacgtgttacggcagagcaggtgggcaaggccagggctaccccaggcccatgtggcctcctccttgcttggaaggggtgactctgagcacaggtagacgcagacgtgtgcagagaatgtgctcttcggaggaagaacactgatgagcgagctctgtaccagcccttgccatgtacagccaagagcctagaatgacatggcccttctcagcagtaataacagatggtctcagcgcctca

SEQ ID NO: 382096 - DNA, 698 bp, Homo sapiens
ggagctcctcggggctgcagggcaccgcagcaggaggcccagcacagaactccgggtcccgcccagtccaagtctcaccatggactctcagtacgagacgggccacattcgcaagctacaggcccggcacatgcagatgcaggagaagactttcaccaagtggatcaataacgtcttccagtgcggccaggtgagtatagccagctgtgacccacagcccacccataccaggcccccagctctggccagtgggcctccggggtgagctgtggggtcatctgcctgaggccaagctgaggccagagctccttcttccaaagcagctgctctgggtcgtacctctcaggtcccaggatgggaggacaggtgaggctgggctgaccccatacttacccctgtcccctccccaggcgggcatcaagatccggaacctgtacacagagctggctgacggcatccacctcctgcggctgctggagctcatctcaggggaggccctgccacccccgagccggggccgcctgcgtgtgcacttcctggagaacagcagccgagctctggccttcctcagggccaaggtgggccccagggaaaggggtctgggatggtgctggggcaggcagctgggacaggctgaactactgggtcacctttcctgcgccaggccactgggcagaacagaggagctggggcctgag

SEQ ID NO: 382097 - DNA, 362 bp, Homo sapiens
aaggagggtacgccaaatgggaagcaattatgctgagacttgggctaaggaagagtctgttgttacaagactacccagagaagccaaatactcttccaccactgtttgaattctattcaaccaaggcaatctcaatgtaatactgaggagctgctcaaagtcttttgccaagtacatgatagaagagcaaaattttcacagccagttcaagatctggtcatcctttatgtttgaatctcacaactggctcttcaacagctcaaagttaaatttgtttcactctttgtccttcggcaagacttctgtccccgttccatcaagatgaacaatttttcttgggggagagctggaaaaatcattct

SEQ ID NO: 382098 - DNA, 380 bp, Homo sapiens
  misc_feature (320)..(320): n is a, c, g, or t
  misc_feature (326)..(326): n is a, c, g, or t
  misc_feature (328)..(328): n is a, c, g, or t
  misc_feature (330)..(330): n is a, c, g, or t
  misc_feature (340)..(340): n is a, c, g, or t
  misc_feature (360)..(360): n is a, c, g, or t
cagaaacccaaccccaaatccccagccccgtccaactcccctggtcttagaataattttccctctcctatgaaaggcctcatccccaaaagtctgtgttgtctgaatctgaatatgaaaagggaagggactgcctcctccccactgcccaccacacaccttcttattttgctgcctaggtcctgcttctcaatttttttaaaaaaaaattgtattagaatatgcataacataaaagttaccattttaaccatcatggggctttgtttgtttgtttgtttgtttgtttgtttgagacagagtcttgctctgcactccagcngggggnancnagccgggggnaccaaagccgaggctttganttccaaaaggaggaggaagg

SEQ ID NO: 382099 - DNA, 901 bp, Homo sapiens
tatctaaatccaacatttacattttatttcagtttgtgctgaaatgcctttcaagccctgtgctttttacctctaattttgtagaatgtattgggcaagtaagtattcttttgtccactgatttttttccctcccctacttttttttttttttttgagagagaggatcttgcttgccctgtcacctaggctggagtgcagtgatgcaaacatgtctcactgcagcctcaacctcccaggctcagtcagtcattctgcctcagccatcctaagtagatgggaccacaggcacatgccaccatacccggttaattttttgaatttttgtagagacagagtcttgccctgtttcccaagctaatatcctacattatatgatacatgcagaaaaaaactttcttcccctttaccccgagtgccctttttagctactttttatcctttacccatacttggagtagtttatattatatacaagtgctttttacaaattagtgaaataaggctctttattataagtgaaaaatgttagccttagttctagggtcattcagttagtttcccctcctttcctagagactcaattaacattgtagactttaacagtttacaaaatgcatgataaacatttaaccaagcatttgcagtccagatggtcttcattcctttctcaccatagctgtgaggtagaaagggctggtaaacgagctgcatctcctcacttgtgattgaatacttgttctagcagaccatctgccactctaggacaattaactgggatattacttagatatagcaatagtagtggtcttgctgttgcttctatgataaatactcactgaattctagatatttgcatcattcatcgttgtttctgaaaacccaggctacctgccagtaaa

SEQ ID NO: 382100 - DNA, 408 bp, Homo sapiens
ataacgaaaatgtggtaattatacaccatggaatactacatagccatagaaaaagaaaccatgtcccttgaagcaacatggatgcagctggaggccattatcctaaatgaattaatgcagcatcaggtaaccaaatacccatggtctcacttataagtgggagctaaacattgagtacacatggacacacagatgggatcaatagacactggggtctgcttgagtggggaggatggcatgaggctatgggtcaaaaaactattgggtactgtggttactacctgggtgacaatatcatttgtacaccaaaccccagtgacatgcaatttacccatgtaacaagcctgcacatttatcccttaaacctaaaaacagaaaaaattaaaaataaataaataaatgaggtat

SEQ ID NO: 382101 - DNA, 523 bp, Homo sapiens
cattgactgctaattagactcctctgggaaggtagaggcgggcaacacataatgccttcgctgtgggagcttcatcaaggggatgattcttggacggacatttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382102 - DNA, 562 bp, Homo sapiens
cattgactgctaattagactcctctgggaaggtagaggcgggcaacacataatgccttcgctgtgggagcttcatcaaggggatgattcttggacggacatttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggcctcgttggcctcagcggtggagctcgtcaggctggaa

SEQ ID NO: 382103 - DNA, 468 bp, Homo sapiens
gaggtcagaagccataagggagagaaatatctattagataagcatgtctgagttgggggctgtggtgaggactcagttgtcaatgatgacaaccagtaatttttggttctagaatttcacatcaaatgcccccactttactggaagcatattgaggaactttgataatcttaaagaagccagtgattttcttttgaacatttctccattttcctttattttcagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382104 - DNA, 490 bp, Homo sapiens
cattgactgctaattagactcctctgggaaggtagaggcgggcaacacataatgccttcgctgtgggagcttcatcaaggggatgattcttggacggacatttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctaccccaggttctagcccaggtattcgtattcctgatgatcactaaatgtagtctgggcttaaggagctgataagcaaagatgatgaaattcaagattttcctgagtagcaattgcttaacattgtttcagttataatgtagtagaaactctgttttaacttgattcgctccagcacccttagatttaaaaatgcaggatatgtttaatatctaacacataatagaccgat

SEQ ID NO: 382105 - DNA, 1821 bp, Homo sapiens
ggcacgaggggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382106 - DNA, 1853 bp, Homo sapiens
gctggtactggcccgaggtgttaggattgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382107 - DNA, 1866 bp, Homo sapiens
gcagctgattcgattcgactcggtacccgcacgagcatccttacacctcagcttcccaagtagctgggactacaggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382108 - DNA, 2456 bp, Homo sapiens
  misc_feature (2)..(2): n is a, c, g, or t
  misc_feature (4)..(4): n is a, c, g, or t
  misc_feature (7)..(11): n is a, c, g, or t
  misc_feature (263)..(263): n is a, c, g, or t
tncngcnnnnncttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttancggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382109 - DNA, 1766 bp, Homo sapiens
gctggtactggcccgaggtgttaggattgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382110 - DNA, 1820 bp, Homo sapiens
gctggtactggcccgaggtgttaggattgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382111 - DNA, 292 bp, Homo sapiens
tatgggaataattgctttttcacagtcactgatgtacaattaaaaacctgatggaacctggtgggctttgtgcttctgcttgataatcggttctttagttgaatggctttattatttatttatttgagatggagtctcactctgttgcccagcctgaatgaagtgcagtggtgcaggcttggctcactgcaacctctgcttcccaggttcaagcgattcttgtgcctcagcctcctgagtagctgggattacaggtatgcaccaccatgcctgttaatttttatatattttg

SEQ ID NO: 382112 - DNA, 2570 bp, Homo sapiens
  misc_feature (2)..(2): n is a, c, g, or t
  misc_feature (4)..(4): n is a, c, g, or t
  misc_feature (7)..(11): n is a, c, g, or t
  misc_feature (263)..(263): n is a, c, g, or t
tncngcnnnnncttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttancggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagagaaaatacttaaaatctactctctcagctgattttcaaaaatacggcggggcgcggtggctcacgtctttaatcccagcactttgggaggccgaggctggcagatcacctgagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382113 - DNA, 2367 bp, Homo sapiens
  misc_feature (1933)..(1934): n is a, c, g, or t
ggcacgaggggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctggaaaaaaaaccaaaggatgagtatatgtcagggtcaaaggccaatgtaatggctcagttcaagtctaaagcccacgccccgggtaaaagacaagttgggcttctgtggccccnngcgggggaagtctgggggcccgttcctttagggggggggaaatcgagagccccctccctggctcagtgaccagggcgttggggggggggaggggttcagcttattaagggggatacggtttcccaactcagggaaacgccaaaaaacatggaccaaaggccccaagggggggacccataaagggcccttggttggtttttctaggctcccgcccccgggcttcaaaaatccgcttgatgagacgggcgaccccgagcgttataaataacgggtttcccctgaagtccttcccctctcaggcacacctcactaacgaaactgcacccttctcttgcaacagggcgtttcttctcacagggcgctcacgcgcgaaggccccccgaaacggcttgaacaccacccttacccacctatggtctctggactgcactgg

SEQ ID NO: 382114 - DNA, 1860 bp, Homo sapiens
ggcacgaggggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggcctcgttggcctcagcggtggagctcgtcaggctggaa

SEQ ID NO: 382115 - DNA, 2643 bp, Homo sapiens
  misc_feature (2)..(2): n is a, c, g, or t
  misc_feature (4)..(4): n is a, c, g, or t
  misc_feature (7)..(11): n is a, c, g, or t
  misc_feature (263)..(263): n is a, c, g, or t
tncngcnnnnncttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttancggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcgatactggatttcaccatggtgcccaggctggtcttgaattcctgggctcaagcaatctacctgcgttggcctcccaaagtgctgggattacagacatgaaccaccacacctggcagaacctttgtgaaagatctcaatttaatatggaaataaaaaaatttgtatgctgaggctgctaacgtctatggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382116 - DNA, 2131 bp, Homo sapiens
  misc_feature (2)..(2): n is a, c, g, or t
  misc_feature (4)..(4): n is a, c, g, or t
  misc_feature (7)..(11): n is a, c, g, or t
  misc_feature (263)..(263): n is a, c, g, or t
tncngcnnnnncttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttancggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 382117 - DNA, 1193 bp, Homo sapiens
cagtaagtttttccctttacactccttttattttttttaatctgacttaatattaaatgctatatttataggaggcattttatgtttaatttaaaagtaaaagatgcagaaatgattcttgtaagtttgctgtagtttggtaataccatttctttgcttttaaataactaaaccccaatatcaatctgcttgtcctccatttcacccccaacagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattcttaatacccactgcagaagtgtcattaaaataatatacagtggaaccagaaagagggttctgtaagaattagccatagcagaacaaaattatagaattttaaatacctctacccaagtagaggtatttttattcagacacctactttttatttataaaaaaatgcattttctattatcaagttcacttatgaaataaaaattataacacatattttccatttagcgtgcctaacatcctaccctgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatgat

SEQ ID NO: 382118 - DNA, 2010 bp, Homo sapiens
tcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagcttttgtcttagcataataacctgtttccagcaagaatataacagaaaaaagtttcccagctttcaaaggtttataatattgattaaaatttagataaacttaaccttacacaaatgactcttactttcctttttattgagagcattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgtacaaaaaaaaaactttat

SEQ ID NO: 382119 - DNA, 1266 bp, Homo sapiens
accttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggttgggtgcagtgtctcatgcctgtaatcccagcactttggaaggccaaggcaggaggattgcttgaggccaggaattcaagaccagcctgggaaacaaacattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgtacaaaaaaaaaactttat

SEQ ID NO: 382120 - DNA, 1194 bp, Homo sapiens
cagtaagtttttccctttacactccttttattttttttaatctgacttaatattaaatgctatatttataggaggcattttatgtttaatttaaaagtaaaagatgcagaaatgattcttgtaagtttgctgtagtttggtaataccatttctttgcttttaaataactaaaccccaatatcaatctgcttgtcctccatttcacccccaacagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggttgggtgcagtgtctcatgcctgtaatcccagcactttggaaggccaaggcaggaggattgcttgaggccaggaattcaagaccagcctgggaaacaaacattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgtacaaaaaaaaaactttat

SEQ ID NO: 382121 - DNA, 1501 bp, Homo sapiens
tcaacccccttaaactggagaaaaacatttaattagtaaaacattaattaatttactttaatttttcccatctctcagtagtggcggggaggaacacaacagttttcaatctatgtctgcatagttgtgtagagctgcagaattttagttggatttttaatttggatgatccctgacagccccaaactagtcaggctaataagtatttgaggcaaaatggctttaatctaacaatttactgagtttacctgaagttggctaaataacactgtatgtttaacttctacctctacataagttgaatgctgataaaaggaactagtagataactatgtatattgataagcactgttaagaaaatgcaaaaatatttctaaacacttttccaaatgttttctactttaagttagaaatagtttcaaatctgagaataaacactatataatctgcactttataggttgggtgcagtgtctcatgcctgtaatcccagcactttggaaggccaaggcaggaggattgcttgaggccaggaattcaagaccagcctgggaaacaaagtgagaccctgtctttacaaaaaataaaaacaaaaatttaaaactgtataatctgcactttatgctaaactagctgtgctcttaaactcaattttttcagctctaataaagggcttaatttgatagaattattctacgattaaattttgaagactgttttcactctcctctgccgcccatagcaagactgcttccatagatttctcagaaccgtagccagttctggctatttggtcaagtctgggatccctcttacctgctattctgcagctgctttctctgtcttacattttttgggccacgtctaatcttaaagagtaaactctacccttggtttgcatagtgtgcatgacaaaaataacaagaataatggtaatgatgaaaatgataagagcaaaatttgtggagtgctttccacattccaggtaatgtgtaacatacaatttaattcttacagcagtcttatggagtgaaaatactattatgattcccgttttacagatgaaagaatggaggcacagaaaagttacttgtctaagtaacagtctatccttaaagtccacagtcttaaccacttgatttttcatagtgaggaaaatatcccagaaagttgcagtttcaattaatcactaattgtagggtaatttaactataccagtgagtcctactagcagaaatatttgggcaacataagcccactgactggagctttggtttacctatatcctggtcccggcgaattttccgcaaaggttcccctttcaggtttcattgcttactttattcgttgcttacaggacccatcccctagggaacctccggacatccggggcccgccccttccagagaagactcggggtgcccgaatgtgacacccttttcttcccgtagccacgttatgttaccactatggtgtacctttatcgtagtattatttgttcc

SEQ ID NO: 382122 - DNA, 803 bp, Homo sapiens
accttggggaaatcaatttcccaaaatacagtgggaagatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaatggacaatgatgaataaatgtgaagctgtattctta

SEQ ID NO: 382123 - DNA, 1255 bp, Homo sapiens
cttaggagttaagttgctttccaaaaaatttgcacaataattcaatccctaataccacatttggggaaattattattggtctttggaagtctccaatggaagatgacaatgaaagaccaactggttgctcgattgaacaagcctggtgcctctacaccccggtgattcatctggcccagttccttacatcagctgtgctaataggattaggctatccagtctgcaatcttatgtcctatactctatattcaaaaattctaggaccaaaacctcagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggttgggtgcagtgtctcatgcctgtaatcccagcactttggaaggccaaggcaggaggattgcttgaggccaggaattcaagaccagcctgggaaacaaacattttctttggagcattttcttctttggaggattataccttgctcatcttggcacaaaagaaggcgaaaggaagtaacatgggattgggaaaagagcaaggagataaagtttgaggaaaaaaaatcaccatgttgatgtcttcttgagtaggccaagttgcgtataaagagaaaatgacaacaggagattttaaggtatgatatattgttaagagtagtacatatttaagaagagaaaatatgtttttgaaaacaaatttaaacttgaaaggatgattttcatattttgaagggatttataacttcacaaagcatctccattctatcttgttcagctttacatttaaaaataaactcttcttgttcatataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagattattttgcatatgtacaaaaaaaaaactttat

SEQ ID NO: 382124 - DNA, 1969 bp, Homo sapiens
  misc_feature (157)..(157): n is a, c, g, or t
  misc_feature (1969)..(1969): n is a, c, g, or t
cgggaggctgaggaggcgctctttcctgatacgaggttacaggctggggtctgatgtgggggtggggggcatggtggggtctgctttctctgctgtattcttctgcaagggcgaaagggcgtgtggttgcgcctgaggaagatacttttctgtgttnggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaaaaaacaaaacaagaaaaaaaaaaacaaaaaaaagaaacagaaaagcacaaccacaaagacgaggcgcgaaaaacccccgggggacccaggacaacacagtggacaagggcaagagacaaaaagcgggggacacaacaccgggaagcaacggccagagaaacccgcggcaagccccacagcgcggcaaagcgggcaccccggggcgtacacacccgaan

SEQ ID NO: 382125 - DNA, 1342 bp, Homo sapiens
  misc_feature (338)..(338): n is a, c, g, or t
  misc_feature (1342)..(1342): n is a, c, g, or t
ggttcctgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttnggggttgtacattgccattccatttctcatcaaactatgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaaaaaacaaaacaagaaaaaaaaaaacaaaaaaaagaaacagaaaagcacaaccacaaagacgaggcgcgaaaaacccccgggggacccaggacaacacagtggacaagggcaagagacaaaaagcgggggacacaacaccgggaagcaacggccagagaaacccgcggcaagccccacagcgcggcaaagcgggcaccccggggcgtacacacccgaan

SEQ ID NO: 382126 - DNA, 1982 bp, Homo sapiens
  misc_feature (157)..(157): n is a, c, g, or t
cgggaggctgaggaggcgctctttcctgatacgaggttacaggctggggtctgatgtgggggtggggggcatggtggggtctgctttctctgctgtattcttctgcaagggcgaaagggcgtgtggttgcgcctgaggaagatacttttctgtgttnggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccagacctcagcagggcccaggttccagcccagatcccagcatgtggtcagagctggtgtgactgaagccaacaggtgacacggtcatcgaagagcagcagacaaaactaacccaaaggcagctgaaagtggagggcaggtgaattcccagccctcgccggattcaacttttgccaacggtgaagaactgccctgagctgcaaaccttacaaagtctgtaactctagataaaccataccatgtgctaactgcactgaaataaaacactaactacattataatgtcaaaacacccccaccaccacccccccccccccaccctcaccacccccacacacaccacacccccacccaacaccccaccccaccccaccccaacacactccacaagactcagctcctacctctcttcccctctccctaccgtacccactacccccctctctatcacctcaccaccaccaccaccctatccacacccgcccctacctaccctcccccaccagcctcatcacacccacatcaccctcatctcaggcaccagacagatctgctcatcctactgcagtcactctaacgcccactatctctctcctccccaccgcataactcctacatactacacccgcaccacccactcactcccactactttctcaccaaccccgccgccatgctcacccatctctcccgccacgcgtaccctactccccacccccctgcccca

SEQ ID NO: 382127 - DNA, 1746 bp, Homo sapiens
  misc_feature (157)..(157): n is a, c, g, or t
cgggaggctgaggaggcgctctttcctgatacgaggttacaggctggggtctgatgtgggggtggggggcatggtggggtctgctttctctgctgtattcttctgcaagggcgaaagggcgtgtggttgcgcctgaggaagatacttttctgtgttnggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtc

SEQ ID NO: 382128 - DNA, 1322 bp, Homo sapiens
  misc_feature (1322)..(1322): n is a, c, g, or t
gccacatgtatgtcgctggcttcctgcctacctctcagttccctgtttgtttatctagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccagggggccggcacctgcaatgctcaggagcccagctcgcacctggagagcacctcagatcccaggtggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctggttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtcaaaaaaaaacaaaacaagaaaaaaaaaaacaaaaaaaagaaacagaaaagcacaaccacaaagacgaggcgcgaaaaacccccgggggacccaggacaacacagtggacaagggcaagagacaaaaagcgggggacacaacaccgggaagcaacggccagagaaacccgcggcaagccccacagcgcggcaaagcgggcaccccggggcgtacacacccgaan

SEQ ID NO: 382129 - DNA, 1796 bp, Homo sapiens
  misc_feature (157)..(157): n is a, c, g, or t
cgggaggctgaggaggcgctctttcctgatacgaggttacaggctggggtctgatgtgggggtggggggcatggtggggtctgctttctctgctgtattcttctgcaagggcgaaagggcgtgtggttgcgcctgaggaagatacttttctgtgttnggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagacctcagcagggcccaggttccagcccagatcccagcatgtggtcagagctggtgtgactgaagccaacaggtgacacggtcatcgaagagcagcagacaaaactaacccaaaggcagctgaaagtggagggcaggtgaattcccagccctcgccggattcaacttttgccaacggtgaagaactgccctgagctgcaaaccttacaaagtctgtaactctagataaaccataccatgtgctaactgcactgaaataaaacactaactacattataatgtcaaaacacccccaccaccacccccccccccccaccctcaccacccccacacacaccacacccccacccaacaccccaccccaccccaccccaacacactccacaagactcagctcctacctctcttcccctctccctaccgtacccactacccccctctctatcacctcaccaccaccaccaccctatccacacccgcccctacctaccctcccccaccagcctcatcacacccacatcaccctcatctcaggcaccagacagatctgctcatcctactgcagtcactctaacgcccactatctctctcctccccaccgcataactcctacatactacacccgcaccacccactcactcccactactttctcaccaaccccgccgccatgctcacccatctctcccgccacgcgtaccctactccccacccccctgcccca

SEQ ID NO: 382130 - DNA, 461 bp, Homo sapiens
accttaccttcctaaatagctagaactacaagcgtgtgccaccatacctggctagtattttcattttttgtagatacaaggtctcaatatgttccccaggcttgaaataagtgcattttaaaatacatgcgttggaaagatattagagttataaagagtcaatttgcaaatttcgtctgcttgacaatgtcatacaggtcaaaatcctcaaatcatgagatttatgtgtcctacatgtactggacaaagaaaacaaattcttttcaagctattctcattaatggaattaactatcagaaggaaaatccaattatcagataattttttaggtggggctttggaagattattctgtgcttacatgtgaacatgaaattatgtcaggttctctaggcgtggtggctcacgcctgtagtcccagtgctttgggaggccaaggcgggcagatcacgaggtcaggag

SEQ ID NO: 382131 - DNA, 114 bp, Homo sapiens
ctgcagaagtcattttcagttgttctctgactcccgtaaacaacaattcctgtcgccttatccttttgatgcctggttccacttctatattttcacttggacatgattctcact

SEQ ID NO: 382132 - DNA, 862 bp, Homo sapiens
ctagacatgtggagaagatcaaatgaggtattgagtgtgtgagctgtgttaggctggctcctactctctccccttgcactagcagaaccagtgcccagtcagatacttgggaagggctgaaggagggtctcacctgtgcccagaaataagtccagacagctgagagatgggtgccactcttcctgggtaatgccatacttgaaaggtagtgtgccccttctcatggatcctgcaccctcctaaggccccagctgctgctggtgggctgaagaccatgatggactaagcaacactgtcccaacagaaaagtggagaattccctctctacctacaatagaattatcctaactcaggttgttagtacccaattgtcacttgggccttgatgttttatgaagtttttacaaaacactgctttccatgttttttgttgatttgtgtatatttttgcatatagccgtttccaccggatttagatagtggagattgagccaggaggaaaagctgagtgacgagatggtgtgctattctcatttgttaatctctagtctgctaacacttttttcttaggaattgtctcccaggaaatttctgttaagccctgctttactatttcaacagacccatctacctatgtgattttttccccctggctcttgagtagctttttatttccttacagtatttttttttaataaacttttaggatggttttagatctacacaattattgcaaagatagtacagagtatcccatatgcactgtcccctattattaacatcttacattagtatggtacatttgtcactgttaaccaatattgatacattattattaactaaagtacgtactttatttgga

SEQ ID NO: 382133 - DNA, 2103 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggtaaaaaaaaaaa

SEQ ID NO: 382134 - DNA, 523 bp, Homo sapiens
  misc_feature (485)..(485): n is a, c, g, or t
accagcctggccaacatggtgaaactccatcgctactaaaaatacaaaaattagctgggcatgatggcaaatgattgtaatcccagctacccaggaggctgagggaggagaattgcttgaacccgggaggtggaggttgcagtgagctgagattgagccattgcatcgccagcctgggcgacacagccggactctgtctcaaaagaacaccgagtactgaccgacttaccaaaataatagaataaaatgtctagggccaggcgctaggtggctgggttcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccgcgacgacgaagganctccaggggcttatgagtcccgatctccgatgctgaca

SEQ ID NO: 382135 - DNA, 8312 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaatacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382136 - DNA, 8270 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382137 - DNA, 8809 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatattaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaagaaaaaaaaaataaaaaccaaaaaagaaaaaaaagaagggcggcgctgcccgatacccactgacgcctacggagcggggccagaggcgagagaccggcacagccggtgcccgagagcaaagaggaaggcgagacacgtagggcacgtagataacgaaaagagagcagaggcaaggggcaaagaaccgacaaggcaaacaagcggagagcaaacagaccgcgcgccaccagacgccaacacacgagaacaaccacacacggtaaggggaagaggacaacgacaaccccaagacatgacgtcggcgccgacacgaaaacaaccaggcgccgggtcgcacga

SEQ ID NO: 382138 - DNA, 8763 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382139 - DNA, 8687 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382140 - DNA, 7498 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttttggtttgttaatatggttgtggtcattctatctgtaatagtgtcaacaataaaaataaagttaaaaataaatatt

SEQ ID NO: 382141 - DNA, 8653 bp, Homo sapiens
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaaggccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382142 - DNA, 3651 bp, Homo sapiens
caaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgccataaagtcttaaatgaaaagatgtggaaaataactaaaatagtgttgtcattgtgggaatttggttaaatattttgtctcaaattccttaaatttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382143 - DNA, 2576 bp, Homo sapiens
ccttaagtgacaagtagcacaggggacccaagccatgttgctacttgtcacttaaggcaggaagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382144 - DNA, 2739 bp, Homo sapiens
gaccacagagaacgccgcagatgtatcactccttaggctatggtaccgcccccccgatctttttaccaaccaaaggcttaaaataaggaatttataacccagaacttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctcttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382145 - DNA, 1160 bp, Homo sapiens
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcagtgagtcttaaccactttctttcccagtaggagatatagagcatgtgctgtgcacaggttcaaggggaaagtgccagggcctcgaagtttctgctgctccatttggagtatattccgcttccccaaaagtttagtccaaggctcgtatttttgaagttccactcggtaccaccagcacaggtttcaccacatagacctgttgccacctaaactatttgctcagtattcttaagctggtgcatta

SEQ ID NO: 382146 - DNA, 211 bp, Homo sapiens
gtttccttgctcaggactctgtccctgcagaaaagaggaacacagagatgttagacaatctgccatctgctgggtcccaggtgagtcaggctttcctctgacatggttatcaaatatggggatcttatcttcctaatttgtggacttccttatttaattaaaccacatactcatttccattaagtttttatataaatatcactttactgag

SEQ ID NO: 382147 - DNA, 777 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagtggttgtgtggtccgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaaagaagaaattagagaagcattccgtgtgtttgataaggatggcaatggctatattagtgctgcagaacttcgccatgtgatgaccaaccttggagagaagttaccagatgaagaagttgatgacatgatc

SEQ ID NO: 382148 - DNA, 8373 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382149 - DNA, 8315 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaattaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382150 - DNA, 8717 bp, Homo sapiens
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382151 - DNA, 5533 bp, Homo sapiens
ctcctcctccccatcgattgtatgtgtatgcaggttagaaatgcattcaaaatattcagccaatacttactgaatatcaactatgtgccaagacacatagacaatatacaagacccctgctcttatggagtttatactctagtaagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatt

SEQ ID NO: 382152 - DNA, 5690 bp, Homo sapiens
  misc_feature (5494)..(5495): n is a, c, g, or t
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccctcgatgttgggtcgtatgtgggaggcatgcacatttactttcataatgatggaaacattgtttcgataggtgccaacagtatgagtgtagtttgggggaggttaatggtggaaggacatggataaaggagcggagaaggtggattgggggaaagtttgtcagttcttggttgttaagtaggtctnnaggccaggagaagagaagggcgaaggaacaagatacgagagcacggcacgcgaaaccgacggagcagaaccgaaacaaggagccgacacacggagggcagcaagcgcaagcaagcacggcaagcgaagagcagagcggccaacaaccgacggacaagaggccagcgcgagagagcaaggacagagcacggaccgg

SEQ ID NO: 382153 - DNA, 2502 bp, Homo sapiens
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaccttcacatgcagctcccatgccaccctccagaattcaccaacacacaggcccaccagcaacaggctacctttgcacaatattctctgatgacaactccaaagccccggctctttccaccacactgtggtcccctagatggggctgttgctgagcccaccccaatccagatgtgatccccctgtgatctacttctggcaagattctcagtctggacaggtcttccctatgagatagaacctgataaggagctagggcaattctgacaacattaccaaaggcccacataacttctaaattttggtctggtctgaaggaaaacctgttctcgccctagtgatggatgaactctcttatctctggcttctagagggaaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaatctagatttcggtcttcattgctgtccatttttgtaatgaacgagtgtttttcctttagctagtgtatcaggcagggttctaccagagaaacagaaccagtaggagatacatatacatgtccagatttatttcaaagaattgatttacatgattgtggggattggcaagtccaaaatccatatggtaggcctgcaatctgtaaacctttgggcaggagctgatgctgtagtttgcagatagaattccttgttccttaaaaaaatctgtttttgttcttaagggctttgaatgattggatcaggcccacccagattacctagataatctcttttacttaaagtaaactgattgtaggtgctaatcacatctatgaaatgccttcacagcaacacctagattagcattcaattgaataactggggaatacagcctagccaagttgacacataaaattaaccatcacagcaacatgcctgctaaattttatcgaccgtcttcagactgttaaggattgtggtagagaactgtgacagccactctcagcatcaccctgaaccaaaggcccctatcaagtaacaatatagccaagcaaaattccagtcaatagagacattgactggttggctggcttcccaagggatagcaccagacaagaaatgcaaggatgaggaaaccaggcacgggagagggaggggcaacagaggtccagggtttggttatctttttatttttcactgggaggtggtaagttagccctgttgcccatgtatgcagatgggagaagtgatttagaaactccaaagcaattggtaatccccaaaatgggtgtatctggtttgaaatgaaaccttattttattggaaatggttggtttcccaattctgtttgccattggccaatataattgtgggtttgcacatggccagcacatgccaaacagaagtagacaaaggtctcactctgtaagtgggaccttggggaggagctgcctccatcataaagggaggggttagtaaaaatggtctcttaagcctgttcctgctacagttatagaggttgctcagaaccttctcagcaaatatagcagttatctattgttgtgtattaaaccatttcaacacat

SEQ ID NO: 382154 - DNA, 693 bp, Homo sapiens
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcagggcctggccagcccgctcctgcgctgcccttcgcagcgactcctggatcgcgtggtcaggcgctatgcagaggtggccgacgccggcagcatcttcatggaccacttcaccgacggataa

SEQ ID NO: 382155 - DNA, 398 bp, Homo sapiens
ctgtcatttctcattctctctgatgtgatcctcagtgacgattcgagaaagttcctagctgcgacctctggcctgaagatctgacaggatgacccttgccagtccacccctctgccagggctcaactcacctgcatcattctctgacagctctttgccagccgccagtctagctgagtattctctcttagaagctcccatatatatcctgtttcaaaatacagagagacaactttgaaagccaagttcctcttctatctcccactgtaaagaataaccaaacctcagccattacagaagccaactttgacaatacagcatcctcttcccacctgacagcctcccacccactcccatgggcatgctgtgctgggaacttcagcaccttgctggtgccat

SEQ ID NO: 382156 - DNA, 339 bp, Homo sapiens
ttgtggtctggccatgcagggctgtacagagtaaaccacctgatagcaataactcaagcataccctgagaatgactttgtatgggagaatctgtgcctctgcatcagccccaaagacctgcagcattgagcgtgtcctgcggaaaacagagaggttccagaaatggctgcaggccaagcgcctcacgccggacctggtgcagtgacgattcgagaaagttcctagctgcgacctctggcctgaagatctgacaggatgacccttgccagtccacccctctgccagggctcaactcacctgcatcattctctgacagctctttgccagccgccagtctag

SEQ ID NO: 382157 - DNA, 902 bp, Homo sapiens
ctgtgaagagtgcccagtggggccctccctggagtggagaggagtgactccccgtggccagcagccttgccttcctggggcacaccccgcatacagcttctccccgggctgggacagtggaagggctgccttgccatcacctccctgcacacttgctttgcccaggtcctggggctctgctcctgccagctcctgggtggttcatgctcctgtgagggcactgaccagccaagcaggaggcctttgtggtggctgagtagaggcatgtggggtcactcatgcgccctcggggtccaggccccactagtcctcctccaagtcccattttggctggtggacacccaggtgtgtggcctagaggctatcaggctgcagcttggggaagcaaacaagggagggtgatggttcctggccccacaccatcattctggtgtcagccctgagagggtgcctgtcacagcaggttccaggactgctgcctcctgaggatggagaaactgtggcaccctgggggccactaagggaggccagctgattgcagccacgtgtaccttcctcttctcgtctctgtgttttgtagatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaaggacttt

SEQ ID NO: 382158 - DNA, 1102 bp, Homo sapiens
ccctgggcaggccaggtgggccagctgggggcacagggcagctggaacaccccccaggtgcccgtgctgccagtcttcttgcagccacctgtggtcagcatgcctggcccccggctgcggatcacgtagccttctgccctgtcccttgccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382159 - DNA, 640 bp, Homo sapiens
cttttttcttttcttttttctttctcttttacttttcttagaatatgcttctagagacaaacacttctccctgaagcttaggggcttggccctggcacctctgccccctcggcgaagctcgtgggagcctgcaccctctctccaggggctgccccgtttcccccggccgggtcggccctctctctgaactgctgcctgtgtctgcccctccctgcacactgacgacttttgcttagtgtggtagcgtgtcccagtgtgtgctgttctgcctaaccctgtggtcttgtgtcgtttctttttcccttgcagggtctgccctgaagcgtctctgcctaggcaaagaacacagcagtagtaattatccgggttttttcccctttgtcctctctcatcgcatgggctttctcgtggctagcgcacatcagggttcccgcggccgggcgggcgtgggcctgccctgtgcctgccccgcgcctgctccatgcctctcggccgggcactgcttcgcttctgcctggcgggatcgctgtcctcggctcccccgtgtgtctcgtggcgcctagagtttgtgcggtctcgccagttcacatctaacgggcttatccttccccagaacaccgtcgaagtgccgatcattaat

SEQ ID NO: 382160 - DNA, 408 bp, Homo sapiens
tgtgtgctgttctgaggtccccttcgacggtgtctagctaaccctgtggtcttgtgtcgtttctttttcccttgcagggtctgccctgaagcgtctctgcctaggcaaagaacacagcagtagtaattatccgggttttttcccctttgtcctctctcatcgcatgggctttctcgtggctagcgcacatcagggttcccgcggccgggcgggcgtgggcctgccctgtgcctgccccgcgcctgctccatgcctctcggccgggcactgcttcgcttctgcctggcgggatcgctgtcctcggctcccccgtgtgtctcgtggcgcctagagtttgtgcggtctcgccagttcacatctaacgggcttatccttccccagaacaccgtcgaagtgccgatcattaat

SEQ ID NO: 382161 - DNA, 5363 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382162 - DNA, 4216 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaaggacttt

SEQ ID NO: 382163 - DNA, 4812 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382164 - DNA, 5315 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382165 - DNA, 2038 bp, Homo sapiens
ctgtgaagagtgcccagtggggccctccctggagtggagaggagtgactccccgtggccagcagccttgccttcctggggcacaccccgcatacagcttctccccgggctgggacagtggaagggctgccttgccatcacctccctgcacacttgctttgcccaggtcctggggctctgctcctgccagctcctgggtggttcatgctcctgtgagggcactgaccagccaagcaggaggcctttgtggtggctgagtagaggcatgtggggtcactcatgcgccctcggggtccaggccccactagtcctcctccaagtcccattttggctggtggacacccaggtgtgtggcctagaggctatcaggctgcagcttggggaagcaaacaagggagggtgatggttcctggccccacaccatcattctggtgtcagccctgagagggtgcctgtcacagcaggttccaggactgctgcctcctgaggatggagaaactgtggcaccctgggggccactaagggaggccagctgattgcagccacgtgtaccttcctcttctcgtctctgtgttttgtagatgaccgcacctcgagcaggagtggggatgccacgtctgcccccagcgcccggccctctgtccaccacggtcattcccggagccgccccgaccctgtccgtgcccacaccaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382166 - DNA, 4284 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctgtctgtatttgttcttttgtattttatcacctcctggcccttggttttctccccccaccccctccctgtcttcattacctttcatacatttcataggatgcctcccccaccccatcgaagtcacctatttaatatcaaagtggaaccccatgagccggtcccctggagcggcggccgccagcgcctacccccaagccccacacagcgtgtgtgcatgctcatggctggtgcctgggcacggaaagcatgtgcagcggctggcctgccttccgccccgggcacctctgcccagaaggactggagccctttgcattcttttcgtcacctcatttatttaatttttttttttatgttggatgtagtttttttttctgttgcaattgtggcaaatatacatgtccgctgtccccagttccagcgacaacaaaaagacaaccccaacctcctccagatgcacagtgtgtgtcacgcgtgtctggactgtgaagacatgcacatagcgagcctatacggttctaaaggtcactggagggcgtggtttctgtaccagggccaaatcccagcacccagtaccctgcacacccaccgccctgtgccctgcatgtggaaatgctgagagaacgtgctccagttcgggcctccccagcccctccccactggaagggcaggtctggtcccctttgtcattgctc

SEQ ID NO: 382167 - DNA, 2236 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggtatgagcagcaggcgcccacacaagcccctccctgtttcatgtacaggcctccttctgtgcatgacccagccggtatgtgccccgtgcccaggtccatgcagggggctcaccctgccctgtctcccatggcgcagagcagcctgtggggctgtgttcctatccttgttttctgctgaatcagctcagtcaaagcagcctccaggtttgagtctgccctgttaccccaccaagtaggtggctcgcatggccatataggtgtgtgttgaagagctccgctgtccttccttcacagtgttaacctggcaactccttgctcctgtccctttcctctgtgccgcacacctgcagcagacacgcctctgctggttctgcttgctttggggggtggggtgggaaagtccctgttggtgctgagactctgattttaaagtgttcacacagacatttatcactgtgcattgatctgcacctgcacctgcctgtacagatgccaacaagcccgtgctttgggctgtcagttaaatcttgttggtcctttgggaggctgaaaatagtcacttgaacaaatttaaggtttaattccttaccagttggcaggggaaagttactgattctataacttgacataaccttatggcacattcatgaaaaatatctgtaaatcatttttaattttatgtcatgtgcttccagtgactcccattatcttttggagattcgttcccatgggggacaggtcagcctaataacgaaatccaaacaaagcaacgagctgaaacaaggtgatctcaggtaaagggcttggcctcagcctgggctg

SEQ ID NO: 382168 - DNA, 204 bp, Homo sapiens
ctgtgagtctcacggctcttctctttttgtgtttctttctccaggtggagaagtcagaactggcccccactcgaggggccgtgatggagcagggcacgtcctcgtcaatgacaggtaacagcttcctgctgaaccctgcgttcacaaggtgctgcctggcttccttgccccagaaccttctgcatccgcaccctcgtctttcat

SEQ ID NO: 382169 - DNA, 5507 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcgaaaacagtgtgaaacaacatctttttcttaccctctatccatataaaatccaaagcaaccagcctcctagggagcacaggagttgggagccagttctgggctcagctgcatccacacctctggaggagggtgctgaggggctgcgggtgctgggctgggctgtccccgg

SEQ ID NO: 382170 - DNA, 4072 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaaggacttt

SEQ ID NO: 382171 - DNA, 4228 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctccccaagaactaggcttgtccactttacagattgggaggtgagcgacgcacccacagctccgcagctggcaggtggaaaggacaggccaggccaggccaggccagggctgtgactccacagctcagatacagcagcagccccagcctgggcagcccaagccccgcactcagagcaggtagccctggtcttggcagacaggcccacctctgcctgagttctgtttgtgcccaggctggagaccagggcaggtgtgcatgtcacccaagtgacaccagcgtctggccatagctcacacgcacctgagccaatgtggggcggaagtgaggacctgctgtcctaggttttcacacctaacttgtttgatgtcagcgcgagttggagaagcatctgctgtttttcagctttctggaggggtttgtggaagactggtgttatttctatctcaaatatttagtaaaggtcatttgtgaatccatc

SEQ ID NO: 382172 - DNA, 3774 bp, Homo sapiens
  misc_feature (534)..(534): n is a, c, g, or t
cggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcnccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcagcctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaaggacttt

SEQ ID NO: 382173 - DNA, 185 bp, Homo sapiens
acgaggctggtgtggctgttggtgtggaggaggaatcgcagcaacctgtacttgatgagtgtctctttgttttcttccctttatattcatttgcaggctggacggtttaccacccaacgtctgagagagtgacctataagtctagtagcaaacctcgtgctcgattcctcagtggacccgtatct

SEQ ID NO: 382174 - DNA, 312 bp, Homo sapiens
gtagaattttctctaaaaaaactaaaaccagctatcggtatggcaaaataaataataaataataaataaataagggaaggaaggaagcgaactggagcactgaatggtataccaggcaacccgaatatcgttctgcatttagtgattataacacgtcgccaagagagtcatcatcatagcctgtatttactacacctagaaaatgctgctcacagagctggtattattggcccaagttgacaagctcccatgaggaagaaatgggattagaaaacaagtccgtctggctctcagcctctgcttgttccattt

SEQ ID NO: 382175 - DNA, 1018 bp, Homo sapiens
tgggaaaagctccctcagacgtgggcaccaaggaacaggtagaagatcactgtcattttcctgttgtgttttctgccgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagtaagtattactcaatgacatttaatctgttcccttttacagttaaaaattattttctactatcacatttgggattaagttaaaaaaattatttcctttctttcttgtatggcctacatttctatgccgaagtgagcttggagtgaagtctagtacgtctgtgcagcaaagagaccagagtaagagagaaggcgatttgttttctgtgtagattttggctttgtgcaagtgatccctttaagaaatcccagtatacctgggaaatgtaggttgttttcattgaaaaacaaaaaacacattgtttacaaaataattctccctccagctaggtcccttttacttttcaaatgtgattaagaaagcaaaaatttaatttgcatacaagtatttagtaactcagctacagttgttatttgtggaaaatggttggtgtagagtatctttttaaaaatgttcttttagattccagaagtaggtgtagagtattttaatttaatagttgtttagctttctattttgaatcctattaagatgtaaatatttctactcctggcttttgacttaataaaaaaatttctttttcacaagtaaagatgcttattcctcatgccagattaagactcaagataaagattatatatgtaagcataatagaataatcttaggctggacacagtggcttccacttgtaatcccaacactttggaaggccaaggagggaggattgcttgagcacaggagcttgagaccagcctggacaacatagtgagatcctgtctct

SEQ ID NO: 382176 - DNA, 1151 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagaggtaagcggtgttcacatttgacgccttgtaactacctggcttacttatgatgcatgtaactagctaacttaactagtagatgtgaagtacatttttaatttcagtttgataatatattgcattttaattctttggcagaacctcctcctttatttgtaaattagaaaaggattatatctgcttataacaaaaattcagataaaaacttagtccctgctccttgccatcaaatatttgtaacacagagagaaacactagaagcagcttagagtttatctttctagatcattttctgtatatattcaaaggaatttttaaaacatagcgatgtattacttgtatcaattttagttttctacaacaaatggaccatatgaatggttttgcagtttgctttatttctgatgaacatcttccatattgttatttaatatctgtgtgattctttttaaagctaagtaaaatttcttctggacatagtatagtttacttaaccattccctacgttgtaagtccatttaggtattttagaattttctagtttttgtctgttataaataatgtttctggccaggtgtggtggctcacatctgtaatctcagcactttgggagacagaggcaggaggattgcttaagcctaggagttcgacaccagcctgggcaacacaaggagaccccatctctagtacaacaacaacaacagcaaaaaaattggccaggcgcggtggctcacgcttgtaatcccagcactttgggaggctgaggcgggcagattacgaggtcaagagatcgagaccaccctggtcagcatggtgaaaccctgtctctactaaaaatacaaaaattagcctgggtgtggtggcgcacgcctatagtc

SEQ ID NO: 382177 - DNA, 2923 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382178 - DNA, 2837 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacattacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382179 - DNA, 2890 bp, Homo sapiens
  misc_feature (33)..(33): n is a, c, g, or t
tctgttgcagaagctaggtagaatgagactggngggtccggagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382180 - DNA, 2438 bp, Homo sapiens
ggcttgcttgtctggcctagggactatgcaaatatggaccagacccttggggtattttctcacattatattggcaaacaatttgtttacccattggctgtttttgataattttttatcagtctgcaggcttttgttttttacagttaaggatagataaaccttttttgtgctaagaaaagccttttgcaagaatgtcttcaaaccaaggttatttgaggggccacagaacttcattcttaatgtggatatggttatgaacatcacttcataatctcttctagatcttttttctccccttgcttactaacccctatttagagtctgatttcagcagctcacaattttattttacgtttagatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382181 - DNA, 1313 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagtaagtattactcaatgacatttaatctgttcccttttacagttaaaaattattttctactatcacatttgggattaagttaaaaaaattatttcctttctttcttgtatggcctacatttctatgccgaagtgagcttggagtgaagtctagtacgtctgtgcagcaaagagaccagagtaagagagaaggcgatttgttttctgtgtagattttggctttgtgcaagtgatccctttaagaaatcccagtatacctgggaaatgtaggttgttttcattgaaaaacaaaaaacacattgtttacaaaataattctccctccagctaggtcccttttacttttcaaatgtgattaagaaagcaaaaatttaatttgcatacaagtatttagtaactcagctacagttgttatttgtggaaaatggttggtgtagagtatctttttaaaaatgttcttttagattccagaagtaggtgtagagtattttaatttaatagttgtttagctttctattttgaatcctattaagatgtaaatatttctactcctggcttttgacttaataaaaaaatttctttttcacaagtaaagatgcttattcctcatgccagattaagactcaagataaagattatatatgtaagcataatagaataatcttaggctggacacagtggcttccacttgtaatcccaacactttggaaggccaaggagggaggattgcttgagcacaggagcttgagaccagcctggacaacatagtgagatcctgtctct

SEQ ID NO: 382182 - DNA, 374 bp, Homo sapiens
ggttatttgaggggccacagaacttcattcttaatgtggatatggttatgaacatcacttcataatctcttctagatcttttttctccccttgcttactaacccctatttagagtctgatttcagcagctcacaattttattttacgtttagatgcgtaagaggggttccgttcgaggcacgtcggctgctgatgtctagatgagtcccctgtagggtcagagacaatgtcaaactgtgtaagtgaagacctgggtaaaaagatgtttcgaaacctgtacctttttggtgatgggcagttaacttgctgagcagaagctctaagtgttaaatgtggttttatttttagaatttaaaagataaatattttagaaa

SEQ ID NO: 382183 - DNA, 260 bp, Homo sapiens
caggcgctgtgagaggcggtagcggcggcggcggcggtggtatcggcggcagctgtgagggggttccgggaagatggtgctgatcaaggaattgtgagtgggtctgtgggcgcgagcgaggccgtgggacggcagtgatgggagatttgttgatggagaagtggtaggatattcctaaatcggagtcagccctgtgtcagcccctccctgcgggcgccccctccctcccccggccccttcgaagcccctcagcgagtgcg

SEQ ID NO: 382184 - DNA, 2869 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaacattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382185 - DNA, 2993 bp, Homo sapiens
gcgcaggcgctgtgagaggcggtagcggcggcggcggcggtggtatcggcggcagctgtgagggggttccgggaagatggtgctgatcaaggaattgtgagtgggtctgtgggcgcgagcgaggccgtgggacggcagtgatgggagatttgttgatggagaagtgccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgc

SEQ ID NO: 382186 - DNA, 3505 bp, Homo sapiens
gcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgccacttgtgtgcttgagtggttgtttccctgagccatgtctggtttgaaacacctcagaccactactctgtttttcatgaattctgtaattcgcagcactaccagtctgggaaaattattttgttttaattgcaaattcttattcttgaaatgtacctgtgccacactaagtggttacgtttgatttcttaagtaattttctgtctttaaaagctaagcagtaaactaaaggattatatattattagtctcagtggttttcagatttatttttaaaggggaaaacagggaaaacccatcgtatttgtaaagcacttaggattttgccgtttgtttctgattgtttgaagattagggctttttggtgcgtggtcacctttcacctctccttttaggatttagtcctttccagtctgctctttttgtgcgtgtcacaaccatattcttgtggttctggctcatattgtagaactgctgaacataaggagaggtagccagctgtatggtcggatttaatatataatgttatatgttgggatatcttagtggtttgttttctgaggtaagtttcttagtgttgtgtt

SEQ ID NO: 382187 - DNA, 556 bp, Homo sapiens
tttattaatgtgacaggaatggcttcaggcaaaaaaatcaaaagaatttcattttcagtatggatctatgcatctatttggcaggccctaactagtagatgatcaaagctctatttctcttctggccccacatgcattgaggacatgcctgctgttccttaagagcttgggatctgccatccgcttgaaaaaattggctttacctaatgtccatgtttccgggctctgctttattccaatttgaaaaggcattaggaattccaacggatttgcttattatacctcccagttaacttgttatagctcctaattaacattaactaatagcacccagggtgatgaacattaactagtgtgccttaattaccagaaacaaaaccacccttggaaacatggattacccagcaagtctgtattagggcatggcttgggatagcagtatagatttcctttctggctttacaacaagtgcttcttgaagttttgcaattctcttgtcttagatgctttccacctccacctcccccccattttcccattggaaatattttttgaa

SEQ ID NO: 382188 - DNA, 339 bp, Homo sapiens
aaaggccaagaggggtatgtaacatagtgtccaaagagggaaggtccttgggtgaactgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382189 - DNA, 2923 bp, Homo sapiens
tctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtcttctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382190 - DNA, 2463 bp, Homo sapiens
cataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgagggacggagtctccaactcctggcctctagcagtcctcctgtgtaggtctcccaaagtgctagtgtgtccggaattggtgggttcttggtctcactgacttcaagaatgaagccgcggaccctcgcagtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382191 - DNA, 2677 bp, Homo sapiens
tctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtcttctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccaaagagccactccaagagccccccaacgtgccactcaacgcgccccgcaacgagacacaccacgagcccccccaacgcgccacaccacgagccggagtagtaagttacaatatgggagattattccgaagcctggtaggataagaatatacacttcagggtgaccagcaaaatcagaataggtgttggtatagaatggggtctctctccaacacg

SEQ ID NO: 382192 - DNA, 2661 bp, Homo sapiens
tctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382193 - DNA, 2337 bp, Homo sapiens
cataacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382194 - DNA, 2228 bp, Homo sapiens
cataacggcgctggccccgccccttctcgagaactcgcagagctgggctggtaaaattgcagtgctgaagacactggacccggtctgctacaatgctgctgctgcacagagctgtggtcctcaggctccaacaggcctgcagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382195 - DNA, 1566 bp, Homo sapiens
ggacgtggagtctctgcattaaagggccgctggctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataa

SEQ ID NO: 382196 - DNA, 1250 bp, Homo sapiens
agcgggggaccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaattt

SEQ ID NO: 382197 - DNA, 1196 bp, Homo sapiens
agcgggggaccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaattt

SEQ ID NO: 382198 - DNA, 780 bp, Homo sapiens
agcgggggaccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggtgaggccccttcccaggacggcccgcacccttcttcctgggctcgggagctgtcaccttcccacgcaacagcaccctagttaacgtggcacgcaccgccaccacggaaagaggcagcggttgcgtgcgagaggatggaaaggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctg

SEQ ID NO: 382199 - DNA, 1205 bp, Homo sapiens
agcgggggaccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaattt

SEQ ID NO: 382200 - DNA, 1151 bp, Homo sapiens
agcgggggaccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaattt

SEQ ID NO: 382201 - DNA, 627 bp, Homo sapiens
gatactgctagaatcctgtctctcaccatcccagttgcctggcactcagggatacttctatacaaccttagttgaatctcacaaaaagaggtgttgatccttcgtaagtgaggcacccaagacacagatggcttcagtgatttaaattgtggtcataatgttagaggcagagccaggtcagaggatagacattgtggctcagacacctgctcttataggagggacttgcctcacagttttctagttacggtgtctgtaatctacagctttcaaatcaggtgcctggcccatctctgtacacctcttggctcagctgttagaattataggacttttagtgtggctagcaattggataaaggccaggcacagtgactcattcctgtaatcccagcactttgggaggctgaggcagaaggattacttgagcccaggagctcgagaccagcctgagcaacatggcaagaccctgtttctgcaaagttaaaaagttagctgggcatagggctcattcatgcctgtggtcacacctactcaggaggttgaggcaggggatcacttgaacccatgctattgaggctccagtgaaccttgtttacaccactgcactccgcctgggcaacagagcg

SEQ ID NO: 382202 - DNA, 859 bp, Homo sapiens
aacgcagtagttgccctcttaataatgacttgtgcttgcccctttttaaatctatttccaattgatgtatagaaaaagatgaaaaatatatccatgtagttatgaatttcagatgtatgtctgtagatgaacagacattaatatatataaccatggcaaaaatagtttgatgacaagtaattataatctctctctctggccatcattggcgagtgcagtgttgagctaaaagtgacccagaggaggtgaactataatttacttgagttaagaaggataaaaattggagcaaactttccagccaaagcagttaattcccccaacatagtaacttacttaaattcaagtagagtgggtagatctattgaaatgaactttactctgctgtgcatgttacaatgtattaaagtattgcttccaaagagaacagaagagtgaacatttaaaaattttattttaagaaagaaatctgattactctgtgatattttttaaacaataaagagattttgctcttaaaaaaaaaaaaaaaaaaaaaaaaaaaaaaaaaaaaaaagccctataaatctagtcatacattatgagcatcaacctttgagatctctcatcaccgcatgattgcaaaaactcaggcctcccccatgctcggatttctcaaaaatagtcgatgtccaacgttcatatttagatacattgattcgtcatcaccccctcccacagttctttattggcagtcaccatctctttggtgttgtgtgctagagtaacatctctcactcaattatagtgtcatgtatcctctcaaccgtattgtgattatgacgctttactgttagtactcccactccccgaatatttgac

SEQ ID NO: 382203 - DNA, 518 bp, Homo sapiens
aacgcagtagttgccctcttaataatgacttgtgcttgcccctttttaaatctatttccaattgatgtatagaaaaagatgaaaaatatatccatgtagttatgaatttcagatgtatgtctgtagatgaacagacattaatatatataaccatggcaaaaatagtttgatgacaagtaattataatctctctctctggccatcattggcgagtgcagtgttgagctaaaagtgacccagaggaggtgaactataatttacttgagttaagaaggataaaaattggagcaaactttccagccaaagcagttaattcccccaacatagtaacttacttaaattcaagtagagtgggtagatctattgaaatgaactttactctgctgtgcatgttacaatgtattaaagtattgcttccaaagagaacagaagagtgaacatttaaaaattttattttaagaaagaaatctgattactctgtgatattttttaaacaataaagagattttgctcttaaa

SEQ ID NO: 382204 - DNA, 293 bp, Homo sapiens
gtcatcaaagcatgcctgggcaggttggtatacttgaagtctctccactgtccccccagataaaaaataaacccacaagacacagggcttatccatcctcaactgccctttccagcttccgttcactcgaaatatgctctgctcattcccatacaacttataatatactctgtaccattttctggcacacaaacccatcactttaaggatactgaagctacttgttcaaactggttcaaaatgacttttcccttttcctgacttcacatagccttaactaatttacctttttt

SEQ ID NO: 382205 - DNA, 266 bp, Homo sapiens
aggaaaaaaaagaaagaaaagaaagagagaaagagaaaatgtgtgtaactgaatttccatcctgaaggatattttatgcacataaaatgttgggttgactattctctcagcacttgaaaagtgtgccacttccttcttgcctctatgatttctcatgacatttgaattgttgttcccctctgcttcgagttggtatttgaatttaaaaaataataaaattaaataaaaataaaaataaatggattttgtccccttataggtaatgc

SEQ ID NO: 382206 - DNA, 372 bp, Homo sapiens
tttttgttatcactcttatcagagtttctcagttgttttactctttataaataacctttgatttttaatcttttctattttgtgtttattacataattttattactttctgctctttgttacccctctcctttctttcatgttgctgttcttttttcttacttcttgaaatagaagcatggctcaaattttcacctaatgcatgcattcttcaatgttataaatttttccctatgtcttagctttagtatacgttttgatatacatagtactattatttagttcaaattattttcctttttttttttctgagaactccagctccaaaaaaaaaaagaactaacggccaaattttttccaaacttgatgaaaa

SEQ ID NO: 382207 - DNA, 973 bp, Homo sapiens
ttctgcctgtatatggtggcatgagatgtaatgtccagagccaacaattatttaccagggttagattttattcagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttcccaaaaagtcaagaatactgctatacctttattattctcagcttcctccagcccttcttgtttttcctcacttgaaattgaaccttcattgtcagctaagtatatatacttttgtgttttcctggacagagtgcaagtggctcttatcagccaaggtggtgaaggttcaggaaagctgggcagcactgggccctgctcctctctgcacctgtgtgcgccatgacacacccacatgcagattcccaagtctgtctcccctcccccttagcaagtacaaggctgtgcattaactcacctcggtcctagaggagtatcctagtactgcttggcaacttctaagaccctaacttgtgaaactagggaagtaagaaaccgttcaaatttaacatctgtcttcagtcatctttaaatcgtctctctttataaacactctgctcacttagcagaaggactgaaggaactaaggaacttgctaaagagaagaagaaaacaaaagctagacttagttccagttaattctgttattcttctgaaataaaaatgaaataaaaggaaggttcgtaaagaggaaggatgggt

SEQ ID NO: 382208 - DNA, 622 bp, Homo sapiens
gtacaaggctgtgcattaactcacctcggtcctagaggagtatcctagtactgcttggcaacttctaagaccctaacttgtgaaactagggaagtaagaaaccgttcaaatttaacatctgtcttcagtcatctttaaatcgtctctctttataaacactctgctcacttagcagaaggactgaaggaactaaggaacttgctaaagagaagaagaaaacaaaagctagacttagttccagttaattctgttattcttctgaaataaaaatgaaataaaaggaaggcagaattctctttttttttttttttagacaggatcttgctctgtgatggtgcaatctcaactcactgcaacctccatgtcccagatgcaggtgatcctcccgcctcagcctcccgagtagctgggactacaggcacgcacaaccatgcctagctaatttttctgtttttagtagagacagtgtttctccatgttgcccaggctggtctcaaactcctaagtgatccacccgcctcagcctcccaaagtgctgggattataggcgtgagccaccacaccaggccaagaaggcggattccttgaagatgattcaaagccagccattaaggatatccgt

SEQ ID NO: 382209 - DNA, 404 bp, Homo sapiens
actctgtctacctttttgggctttttcagtgatgtttctccagcatttcaaaggcaccatggtatgggtagttaggaatatgtgctgtggtgccagactgtctgggtttgaatcctggtctactgtccactaactctgtgactctgggcaagttgctgagcctctttgtgcctcagtattgtcatctgtataatggaaatcgcggtagtgctaacttcatagagttttgtgagattaaatgtattaatacatgtacgacacttaaaacaacggttactgtctattaaccatttggtatatgaaagagagtaagtgctaaagtaatgttcatttcatggatttaaaaaagactaattcagtaggtgttcatgggattttagggagaagcaactgtgtgcctggta

SEQ ID NO: 382210 - DNA, 218 bp, Homo sapiens
taggtttatatataacatccctaaagtgaagtgttttaaataggagcaaggagaaatttcttaccttaatgatatgcttaaaattagtttctttcaagcgtgaaacatatgagcataagtctgcatattgaaagagtaattggaatgtctgtcattcctttcaaattttatacgtaccatgtggaaggcactggcacaaaataattatttcagcacta

SEQ ID NO: 382211 - DNA, 2282 bp, Homo sapiens
acactcagcaaacggcagcctcaccccgcaggccgcgccactccccttccccaccccaccgccgcgtcccggctcagcgctccccggggaacgcagggggaccgggctcgctgcgtgaccttgggctctcagcccacccacctggaagcgcccatgtgtcaccttacccaggagagggcggcagaggctgcgagcaggacggcagccccctctccccacccccaggaccctgagatcctgcttcacgggctgcaagaagttggggggccaggattcggcgcggaggccgggggtgtgggtggggagactgcagagactcccgagacccccccaagtcagggcttttcgctggtctcgcagccccagcccagcagctgctgcagtcttgcatgttgtggatgcaagcattttgctgaggaaactgcatagcgttcccaggactctagggcccacgacccctcaaaagttaagagccgctgatctaatctaaccccactttcaccctcagttaacaaaagaggaaaactgaggcctgagagggtgtgacttgcctgaaatacctaacctggtgagtgatgggtggaaccagctcctaggctttctgcgcaggtgtccaggggacagagaagggtggtttaaactagagaggtggcaggcagaagtagatggatttgataactatttaggatacaccatcaaaatttaactcaaactggattacacacctaaatataaatggccaaaccataaaacttttttttttaaaaatggagacaatcttaacaatattgggtttgaaaagatttcttttttcttttctaaaggcagggtcttgctttcattgaccaggcaggagtgcagtgccctgatcacagctcactgtaactttaaactcctgggctcaagagatcctctcacctcagcctcctgagtagctgagactacaggcacgtgccacgacacacagctaatttttaaattttttgtagaaatggggtcctgctgtgttactcaggctggtcatgaactcctgggctcaagcagtcctcctgcctgagcctcccaaagtgctgggattacaggtgtgagctttggcacctggccagatttcttaaatatgacacaaaaagtgtaaatgatagaagaaatcaataaattgaacttcatcaaaataaaaaaaaaaaacaaaaaaaacaaaaaaaaaaaaaaaaaaaaaaaaaaaaaaaaaaagggggcgcgcgcgcgagccagcaggaaatccccccgcagggggcgccccaagcaggcggcgcccccgccgcgcttacgtggggaacagcgggcggcgccccaaagaggcggcgggacataatagaatagcagaaagccgaacgggagcgcagcgacgctaataaacaaacgaataagcacgcggaggagaaaacagacgagcaaacaagggagaaacccacgaggaggaaggaccccataaagaagcgagggggggcagcaaataataactggggcacaagaaacaccaccccacacagaaacagaacggctcacgcggcgggggaaaacatagaaacaacacagtcaaaagaggcggacacaacgaggggggaacacaaaaacacaccagcgacaatatatgagagaaggcaggagacaaagacacgcgcgggagccggcgggagacataactgtaggcggcaacacaagcacagccaccacgagaagagcaacaaagcaaaaagagagacacgaagggggccacgagggggagggaacgaccagagggacggaaggccggcgcgcggaggagaaacgaacgagcgagagggacgaagtgggcgacgcgggggacgaggaaagcggagcagaaccgggaagaggaagacgagaaggcgggacgcgggggacgaacatgcacgcaagagggaggccgaaaggaagaacaaaaaagaagaagcgaaaaaataagagggacacagaaggaggaagcaggaaagaagagaaggaaggaaaagaagagcgaacggggaggccaaaggaggggcagacacagagggcgacaaaaggcaggagcaggagacagaccacaagaaggagaggaggaaaggggcgaacgaggagagagcgagggggcaggaggagacgcaggcgagagaggaggaggagggtagcggagcgacgggaacggcggcggagggacgaggggaaaaagacgaagaacgggagagggaaagggaagacggagaagcagcaacaaacaacgcgagacgaagcacgcggcgctagtg

SEQ ID NO: 382212 - DNA, 353 bp, Homo sapiens
cagggggaccgggctcgctgcgtgaccttgggtaagtccctgccccgttcggcccgactttccgcatgcgtgcatcctatgggatggggttgggcaattgtgggagcccatctttctctaacgttctggggtttcttgaacctggaaacttagagaggtggacatccctgttctctcccccaggctctcagcccacccacctggaagcgcccatgtgtcaccttacccaggagagggcggcagaggctgcgagcaggacggcagccccctctccccacccccaggaccctgagatcctgcttcacgggctgcaagaagttggggggccaggattcggcgcggaggccgggggt

SEQ ID NO: 382213 - DNA, 319 bp, Homo sapiens
tgctgtgttactcaggctggtcatgaactcctgggctcaagcagtcctcctgcctgagcctcccaaagtgctgggattacaggtgtgagctttggcacctggccagatttcttaaatatgacacaaaaagtgtaaatgatagaagaaatcaataaattgaacttcatcaaaataaaacgcttttgtttctcaaaatgcacgaaactattaaaaatgaaaagataagccatagactaggacgaatatttgtaaaaattctatctgatgtaggacttgtataaagaacttttacaattgaataaaaatccaataaaaatgg

SEQ ID NO: 382214 - DNA, 1326 bp, Homo sapiens
acactcagcaaacggcagcctcaccccgcaggccgcgccactccccttccccaccccaccgccgcgtcccggctcagcgctccccggggaacgcagggggaccgggctcgctgcgtgaccttgggctctcagcccacccacctggaagcgcccatgtgtcaccttacccaggagagggcggcagaggctgcgagcaggacggcagccccctctccccacccccaggaccctgagatcctgcttcacgggctgcaagaagttggggggccaggattcggcgcggaggccgggggtgtgggtggggagactgcagagactcccgagacccccccaagtcagggcttttcgctggtctcgcagccccagcccagcagctgctgcagtcttgcatgttgtggatgcaagcattttgctgaggaaactgcatagcgttcccaggactctagggcccacgacccctcaaaagttaagagccgctgatctaatctaaccccactttcaccctcagttaacaaaagaggaaaactgaggcctgagagggtgtgacttgcctgaaatacctaacctggtgagtgatgggtggaaccagctcctaggctttctgcgcaggtgtccaggggacagagaagggtggtttaaactagagaggtggcaggcagaagtagatggatttgataactatttaggatacaccatcaaaatttaactcaaactggattacacacctaaatataaatggccaaaccataaaacttttttttttaaaaatggagacaatcttaacaatattgggtttgaaaagatttcttttttcttttctaaaggcagggtcttgctttcattgaccaggcaggagtgcagtgccctgatcacagctcactgtaactttaaactcctgggctcaagagatcctctcacctcagcctcctgagtagctgagactacaggcacgtgccacgacacacagctaatttttaaattttttgtagaaatggggtcctgctgtgttactcaggctggtcatgaactcctgggctcaagcagtcctcctgcctgagcctcccaaagtgctgggattacaggtgtgagctttggcacctggccagatttcttaaatatgacacaaaaagtgtaaatgatagaagaaatcaataaattgaacttcatcaaaataaaacgcttttgtttctcaaaatgcacgaaactattaaaaatgaaaagataagccatagactaggacgaatatttgtaaaaattctatctgatgtaggacttgtataaagaacttttacaattgaataaaaatccaataaaaatggacaaaac

SEQ ID NO: 382215 - DNA, 673 bp, Homo sapiens
ggtgggattggttgctgattcatcagtgtctggttgtgcaagagaacagaaatgtgtgtggaagtgtccccaaagaggcagacacttgtaactttcgcaaatatgacttagcaagaagaaaatatttacatttgaaattatttcaaaatttaaaaagaatatatagaaaaatgggcaaaagacatgaacggccacctcacattaaaagcaacaccagtgtcctcatcgtgaaactagacgcccgatcttatcctcgaagcaatgaatgctcaacaggacctgctgctcagcaggatggcaggagccggagacgtggatgctgttcaggcttgttgagggtgtgggaaaaaggggctgtttgtattctgtgtgggcctgaactgggttgggtttttgagggcagcttggaaatacagccattgtagttttaatctgtaacttttactggagttttaatttgtacacttctattggagttttaatttgtatacttttattggagttttaatttgtatacttttattggttttaatgtgtatactttttgactgaaaaattcaactttaaggaatttcatcagaattatacagattcactgttgcgttattgcaaaatgtgaaaaaaatttaaatgtccatcaatagagaattgggcaaataaatacgataaatat

SEQ ID NO: 382216 - DNA, 471 bp, Homo sapiens
tgtgagttggatcttgcaggatgaattagcattttgtagtcaaggaagagaagggagaaattcatttctggccaagggaccaacctgggcaaagccatggaagcacatgtgtgttgggaatgaaagcataggctggagagggtgacaggttatggtggctgtggagggcgtggaggagatacggccagaagggacccatagagttgggggtgggaggctaagatggaaacctcatagttttatttgaaagatgaaactacggccaaaagaaaggaaatggactggatggggcaacaagacagcagggagaccattcagggagctgctaaagtggtccaggtaagagataatgatgttgactttgagagacatttaggaggcatacgtgcagtaagctggatctggagaataatgtaaagatgggacgccttgaaggtgtcactcagatttctggcttaatgaatgagtaat

SEQ ID NO: 382217 - DNA, 403 bp, Homo sapiens
cccatttatgatcctgccctgggcggctccccacttacaggaaaccccaccaagaggaatttgggctgcatcatttccggcttcctgcctgggctgctggaggtggctggctggcagccccctgacccagtggtgtttggagtggggagagggaggtctccacacctggggtgcctcactatttgggtaaagccagcccagaagtgcatgctagggctccccctcttggcgaagaaggctggtcccttcctcctgagccctggagtcagccccccaggaaggtgttggcggtcaccttgggcatccctctgttgccctgattgggagggggtcccttaaaaagcctaaacccgctgcactccagcctgggcgacagagcgggctccgtctcaaaaaaaaaaaa

SEQ ID NO: 382218 - DNA, 1642 bp, Homo sapiens
  misc_feature (1)..(3): n is a, c, g, or t
  misc_feature (301)..(301): n is a, c, g, or t
  misc_feature (1002)..(1002): n is a, c, g, or t
  misc_feature (1085)..(1085): n is a, c, g, or t
nnnatcattgtactttctcatgagttaaactttttatcattatgataatgctttttgccttaaagtctactttgtctaatattaatatagataacattaattttgttaatatttatatttttccactttttaatttcaacattataatacaaatgttttaggtatgtttcttataaacagtatgcagattgttatccaattcaatctttgatttttaattgaactatttaatttatttacatttaatgtaattactgatatatttgaatttaaatataccgtcttcttaagtgttttcaantgtctcacatgctctctgttctctttatcctcactttttgcctgcttttggaaaatattgtttttgcctccattgttttggaagttacatatctttttagtagtcttttagagtttatcctatagatcacagtatgggtctctgagttagcaaaggctaataatgttaattggcactttcattttcttccataatagtacaaggaccttagaacgtttcaattcatttacttcctctcctgatttgtatgcacttttaatatttttaattttttaaatcttcagcactgtgttacattgtttcatacggtataattcatttagacttcctcaaatggaccttcgtgctggacctcatttctttctgcatctatataacctatcatccttaatcatcttccttctgcttaaagaacatcctttagtatttgatgctggtaaagaatcctgaaaatgtcttaatttcacttttattattgaaggctattttcactggacatagaattctaatgttgacagttattttatttcagcacttgaaagacatttaaattccactaatttctagtttccattgtttctatcaagaggtaagctaacagtctattacattttttcaagtaatgacagctgcttgtaatttttttttccctttgtctttggttttcatctgtcttattgtgatgtacctaggtgtggctnttaaaaatttctcctgcttgcagctcccagggcttctgagatttgtggcttgttgtctttaatcaattttgggaatttttcanctattttctcttcaaatattgatgctgcaccattctctttctcttctccttctgaaattttaattctcattttatctccatatctcttactctctgtagcattgctatccttttgtctctccatgtttcgtcatgatgttgtcttctaacctactttccagttcatcaattttccctacagctgtgtataattttttgttaaaccaagtaaagagtatccactgagctctttgcttttgttagtatatattttaaattctaaattgttcactggttattttttacaactttttcatccttttttaaagttttcagttctctgccaaatttgttgatactgtcttttatctccgtatgtgtagtaaacataattaatttaaagtccgtatctgataaatccattaactggagttctgtggtattgtttctattgtagttgtttctactggatctcatgttttcttatttctttatgggcctggttattctcttgtgtgctaaaattgtatatgaaaaattgttggttgaagtaaagtaaaacttattgtgttatattc

SEQ ID NO: 382219 - DNA, 347 bp, Homo sapiens
aacaaatgtccatagaggttaaataatttgcccaatgttccatagacagtatcagagctgggatctaaacccaggtgatctggctcccgatgccatgttccggtccctgatatttctttgatgatgtaggtatcactctctgattttcaaagacgtgagtgctgagccttggagcagtggcacatttgtctgcagattatccaggtgccctgactccaagagctgtgcactttctacatgggaggcacagcagcctccctgttataccaagtgttggtgaatggaaaccaccagacagtttttgtttttgagacagagtctcgctctgtcgcccaggctggagtgca

SEQ ID NO: 382220 - DNA, 318 bp, Homo sapiens
ggttgtagtgagccgagattgcaccactgcactccagcctgggcgacagaatgagagtccgtctcaaaaaaaagaaaagaagtaggcctgatgtgtttgaggatcagcaaggaggccaccgtggctacagccaggtaacccaagagggagggatgggagctgaggtcaggaaggcaatgggggaagatcgtgcagggccctagaggcctcaaggactttgcttttaccctgagtgaggtgagagccacaggacggtttgagcatagaaacaatatctgacttgtgtttttttaaacaattatattgcaatataaggcc

SEQ ID NO: 382221 - DNA, 428 bp, Homo sapiens
gtgaagtccacctgcttatggacagcccatttgcatggggccctgcgtgtggtgcagcccagggtatgtgaggaaggcctcagaggagctgctgctgccacaggtggtcaccagggcagaggttacactgacatacctccagaccagcccgctccactgtggacaggggcaagtcacatacctgctgtttaccatggggtcacggcagaacctgtctcacggggtgctttgtgatgccaaatggatataggtgggacgtgctggcagcagcggcctcagcgtcgagccatctcccctcccgttctgctccggcctgcctgtgggcctaatggtggcaccgtttaagcacctgctgtgtgctcagcctggggcctgaggctttccatacgtgatcactggttcctaccccaggcctcattcctccctgt

SEQ ID NO: 382222 - DNA, 679 bp, Homo sapiens
actccatctcaaaaaaaaaaaaaaaaaaagtctcctttgccttgcttttcccaaatatatcctatagctgttccaggggctaggagatggacccaaccggacatagcctggattctatagagatagcagagggaaggctaagtcatactacagtgtgaatgattaatagtagatatttcttttcagagcaggttttgtttaggttggggagaaagaggactgcagagaaaagggataaacactgagatgccagaggcaccagggttgcccaccccatagagtccacaccccattccccatgttttttgcatgagccctgctggggggcaggccctgggtcccttcccttctgatcctgttgtcctgagtcacaagcttatccctgtcttggaaccattggttctaagcagcactggagaatctgagacagctggaagaccagagcaccccattcagcccctctaaatttgtatgtggtaaagctggggccaagagagggcagctgttggctcaaggccagccatagtaggaggtctaaaacttgtgtcacccagcgtgctggctggattatttaggctgaggcacaagattcacttgaaccctggaggcggaggctgtagtgagccgagatgacaccactgcactccagcctgggtgacagaatgagtctctgtctcaa

SEQ ID NO: 382223 - DNA, 340 bp, Homo sapiens
tgggaaaggcttcctgtacctatgttactatgaaatgttacagcttagtttcatgcatatggctggtgtgatccagttacttattttaaaaagagagttgatttcctttgtttatatgctggcagtgaaaaacagaatgacagttcgacttaagaatgagggcttgttctcagtacagaaacagaagtagcctagttcaagaagtgcggaccaccgctttgtacaatggtctccaaactttggtcacttcatcaggaaatagtatgagcacttctctccatacatagttatttgtaaagtatacatgcttctgctattgtactctaaaacgtgctgtatt

SEQ ID NO: 382224 - DNA, 431 bp, Homo sapiens
gtggcaccacgaggggcaggcacacatgctcttccatttcacctctgttgcctcctcccgctggtatttaccgttactcccatgctgaaggtgggtctgtaatgccgaggaccctaacattagtgctgaagggtcctggaaaggcttcaggaatccccagacatatcaaagtggaactcttcaccaccagaggagggttagttttccagcatccatccgaatatcacacatcaccacctgcactgctagagctgatcaggaagaaaaaccggtcactgcttcagacgggctcccttccagagtcactgtgtggattgccttctggtcaacatcttggtctcatctgagtgtggaattagccagttgaaatttcactgattttattatcattacaccattttattataaattattatattaattcttcatca

SEQ ID NO: 382225 - DNA, 251 bp, Homo sapiens
ggtgttaggcactgggttcaagagtgaaacctctgatctgctgctgcctgggaggatattaatcatgttacatagggagtaccagactccatgtctctgcccttgatggggagtgttgggagtatttttcatcttgaatgtaagctgaaagttattcttcacaccagaaaggaaaccaagaccatcttagacatgcagtgaagcagacaaaacaaggctgaggaggggcccctggaacagggaaccagagt

SEQ ID NO: 382226 - DNA, 406 bp, Homo sapiens
gtctgataaccaagagctctgatgtccaagggcaatggatgttccacttcaagagagagataatgccctcttcctctgcctttttgttctatctgagccctcaatgaatagattaatgcccattcacattgagtgaggttggatcttctttactcagtctgtgattcaaatgctaatctgtttaccagctctctgttttaccagctatctgggcatcccttagcccagtcaagttgacacccaacattaatcatcacaaagttgtcttagtgcattttagtgtgttacagtgttacaggctcacacctgtaatcccagcactttgggaggctgagataggtggatcgcttgaggtcaggagttcgagaccagcctggccaacatggtgaaaccccatctctactaa

SEQ ID NO: 382227 - DNA, 149 bp, Homo sapiens
cgacatcacagctcactgcagcctcaacctgggttcaagtgagctgtgatgtagtcccagcactttgggaggtggagacaggagtatcgcttgagcgcaagagttcgagaccaaccttagtaatatactgagaccttgtctcaattaaa

SEQ ID NO: 382228 - DNA, 490 bp, Homo sapiens
attaatctaagcaagtacagccttgtagctcattggaagaggtgcttccaacaatctcccaggatcactggagcacaagcagtgaccaccttggcctctgagatgtgtttaaatttgtaggtgtcatttgcttgtattttctctaaatgatttgattattctaagatccttattatcactattttccaaaaaaagataaggattgtttctctcttcaaggatgatagatgttttatcattcccaaaggccatgcttttcttcctgtgaggacaagccagccaaggattagatatttcacgcatgggtttctttatgctcctgcaaaagattgtctttctgtccacacttcttgtgattccttgggagtccatcaggcatggctcagagtgttcactctagtgattcttgggaagtgcctccagcagagctcagagcattcatgctattgattcttgggaagtccatcaggaacagctcagagcattcagt

SEQ ID NO: 382229 - DNA, 547 bp, Homo sapiens
attttagggttgttaatagcctaactttaatatgttgtgtctcaaggaatacggaggcctgaggagagggagaccggagaatcactggtcagtggagcagtcagaacacacacaacgtttattaagttcatcggtatgtgtgggtgtggttcgtggtgccccagaaccagaactgttgtaattacaacagtaacatcaaagatcactgagcacaggtcactataacaaatataatcctaatggaaaagtttgaaatactgtgagaattcccaaaatgtgacacagagatgcacagtgagtgcatgctgtttgaaaaatgatgccaataaacttgctcagcacagggttgccacaaacctttaatttgtaaaaagaaaatgcagtatcttcaaagggcaatacagtaaagcacagtaaaatgaggtgtgtctgtatggacacgtgtcagcttctcaaattgtaaactttaaatatgtgcattttatttggtgtcaattgtataaagcgattaaatttttaaaaggactgatgcagacagcacctggca

SEQ ID NO: 382230 - DNA, 670 bp, Homo sapiens
atgtttcatctctatcacattcactgactttccccttgaattttccttgcctgatatcaggcccatacctactggtatcttcttggtttcatttgcttggtataccttttcccatgtctctatttattaacttttaagttactttgttttacatatttcctttatatacactatagagttggtttttgctttgtgagccagcttgaaattttaaaacaggtaacttaatcacgtttatatttattgatatgacttcatatttggtcttaaatgtcttattttgttatacttacagtttccttctctatgctttcttttgtgtgtatctgtatatatgaatgtgtaagggtgtattttttggtatttcagaaggcttttgcattttgttttattgattcactttacattaatactatttatcatgttcttgatctgccttttccttatttaaccttctcctcttttatttgccagctttaaatatcctttgactcctaattactaagtgaaaatcagtgaacttatttttttctcttctctcttcatcctctcattaaaaatttttttctacttttttaaagaaaacatagcctttacaaatcatttttctttctactcactccagcctgggtgacagagtgagaccccctctcaaaaagacaaaaaaaaa

SEQ ID NO: 382231 - DNA, 221 bp, Homo sapiens
aatattgtctgtgaatatttttctttcttatacaaaagagagatcttggtaactacatgagagcaatacaatatcttaacattttttaaaagttgttttcatttttaattaaagcgatgtgcttgtgctccaacctctacctatctttcccctctttctgggggggaaatgttgccaactgtgccatcaaaaatacgcatacagctgtgtgtcatgctttt

SEQ ID NO: 382232 - DNA, 2852 bp, Homo sapiens
gactagtgattaagatgacagcagggatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggcgcggcatctttcttggatgttttttctctacacagacttctttctttccttggtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttgaccaatgacagaagcctgctgagtttggtctttctcacaggggtaggtagtccacatgaactggcgagcagtggtgaaaacatgac

SEQ ID NO: 382233 - DNA, 3438 bp, Homo sapiens
aagtgatgcttttattatttgttatctaccatggactgagcacttagtacaaactagtactttaccttatctttacttacctagtaagggcacaacctacacagtcccaggcatccacagttttactgcccttgtcagtgattacagagccatatttcctttgtcctgaggtttctgtagaccacggtctcttaaaagtcacagtgctgactgcagttaggccagaccccttccaagctccagttttccgagcttacacagaccaatctggagaatgcatgcctgaaaagactggaagtttatctctatcttttggtaacagtctgcgagtgatagggaaggttgcccaatcattggaaaacgatacattaacaagagttgatggttgctgtgattcgacatagtatgaactctactagaaatgtaatcagatcattgatcctgcaggattgattgctgatttattttgcagctgactcactttaggacagccttacaatatttcgcaactctgtctgggagcacacacagaactccgaatccagataagcagctcataaagggatacttagaagggtgttgactgcctgcttcattgttccttgttcactagcgcaccctagtgaccatctttgctgggtaatagtgacttgcaaaggtaaatatttactcccagatagcccacaggagaaagctacagatttctctggcgtagcacagaaacgaaatgaacctcaaaaaccacttactggtgcgggaactcagatcgtatcctacagctctaatgatgcaggagagagttgtctgaaaggaaaaaccaaaagcagctgcaccaaaccgaagggggcttggcacagagaagttggaattctaacgttaagaagtggcagcagctgtcgagcctcatggtctgctgcgctgtgttgctgattgggtttgagcttgtcgagaggagccacaggtcacatttcttgcccagctgcctttgccgtaagactcagtggcgctagatgtggttacaaccttggtctggtgggaaagtctgtaatcactcatcacctaatacgatagttaccaatccattgctagtatctgtcatcttagaaatggccactgcctgcttccttaggcaatagcgtttcccagagagagattgaggctgatgtccgttatttccaggagcttcctcacttctttaggacggtgggttgggcttgcaacctgttttgcatggctgcctccagcagtgtctgtaggaaggttagaataaataggctaattattcagaataaatgactggtcctttcaatggaacagccagtcaatgcaatcaggcaactggccaatttggtttgatggatttttactgtaatccttatttataaaataaagggattggcctcaaaggtcccttttagttctagtttatggtgactctaattactcagcctaactgaccctttggagtagcactatgtaaacaccattcctcagttagcattaaatcactattgcttgcatcaaaatcccagtaatgccattaaagctaattttactttcacacatccacttgtctcttagtaaatgtatgggtgcttaagatggaaatggttccaagaattccaaaccatagggggtgatatgattatatttgatttttattaaaataaatttagagaagtttaagaaaaaacaatgacaaccaggcctgatctgttgtcctgtagttcagagttattcatccttaacgctcaggtcaagcattagtaggtcaagttggccactggcgttttttatttctggtattaaggttagtggtcaagaatcgagggaagtaaagccttaagttaggcttttttgggtaagggatgggtaccccccttgccctctaaccccggtccaccttgtacacagcaaacctaacagctgagtgttaaacaatgatggatgacgtcttcactacatggaatggaatatgtgttctctgcaaagaccatatgctagatcatggttaaagtaacatttggttgttttcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtaggaccccttcctaaccctatgaatgttcctgagaacagatgagcttgtgtccagaattgcctgtctctgtcctgtgggctggagtgtttctggctcggttttgcagggggagcggggggcgggtcataggcttcctcatgttgaatcagtccttcaaagctaaggagaatagaatacagttatttctggattctttttttggcaggtgagaaaatatggtgattcgtttaccagcccataaatcctggaaaaactagtaaacaacagctgattttaaaaaaatgaaaatgaaaataaataggagaggtagactatggctgagtgtgtgtgtgggggggtgcagcctgtccttccggtctcagggtctgtgcagaaaggcagttgaacgccaagaatctttcctgattcagtaagaaactgaaatcatcgaacattgaccagctacggggaagtgagcccaatgggcctctttcacttatcccctcttggttgtcacatccatagagacaaatatacatccctgaggaagggccgtgcatgtaactttacatgaagggaagtaaaggaagacatatgaaggaaagatagattttgtgattaaaaaataaatattcatgtagctctcttaggaagagaggaaaagaaaggaggaaggccaaggaaggagaaaaaaaagagctaaaagaaaggaagggagataagaaaaaccaaagaaatagagggccagcctctgtttgcttcattctgtataaaaggccccaggagaaagttgctgaatggagagatttcccacatcagtttcctgggcccatatgctaattttcctggtttatataagtaagccaggaaagtaagcaatgcaatttccagaccggttccccagacagctaactgacctgctgaaaatcagctataacaaaagagaagggaacaacatgaatattgactttcctggatgcacaaatttgagttcctcatttgcagagggaagcatgggacttatactgtctgccctgttcattaagagccaagaaatttggtgctgatcctcaggcaaaactccactctaaggaggcctgttctgtgggctttggcagaataggccgtcttcctgcaccctgactgggggaagtgggttaccaggtgccctggagcatcttcttaaaccagggaaagccccacagcacatgaccatagcatggcccagatagggtggccacccatcccagttttcccaggactgagggagttccta

SEQ ID NO: 382234 - DNA, 3060 bp, Homo sapiens
gagggtgggtcgaccccgggaattcggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382235 - DNA, 2676 bp, Homo sapiens
  misc_feature (2637)..(2637): n is a, c, g, or t
  misc_feature (2649)..(2649): n is a, c, g, or t
gagggtgggtcgaccccgggaattcggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgtgtgtgtgtgtgtgtgngtgtgtgtgagngtgtgtgtgtgtgtgtgcgcgtgcgct

SEQ ID NO: 382236 - DNA, 3196 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagggaaggatgactaagagtttagtgctggaagagcagaagaggaaagctggaagatcagaaatgaaattggagctgttgatgcgtgtgtctctatgcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382237 - DNA, 3096 bp, Homo sapiens
cgggggttgcggcattccccttctgcacgatggcaaaatctgggcaaagttgaaagttgcaagattccagtcaaacaattgtccttgcttgggtaaatatcctcaaatgaaaaaaaatcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382238 - DNA, 3034 bp, Homo sapiens
gtagcttgcaggtttctgatatcgcatcagtggacaggcggcatgcactatattaacagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382239 - DNA, 1885 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtgacatagctgagtcttttggcaaatctaaggtcatgaagatttatccctgtgttttcttttaagagttttatagttttagctattatatcaaggtacttgatctatttcaagttgatttttatatatggtgtgaggtaaaggtccaacttcatttttttcatagtggatatcttttgcttgtgacatgga

SEQ ID NO: 382240 - DNA, 2501 bp, Homo sapiens
taaatatttgctctgaataaaactgaactgtgagatatctataagtggcatgttgggcttctcctcttgaatcgaggacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382241 - DNA, 2624 bp, Homo sapiens
tggaggctcctggaggctgcccaggaatgcagttcagtcctcggaatttctaattcttcttcgccctgaggaagctcacaaaggtggacaagcaggccccttctcacccgaaatgtaggaagccatcagcaacctgcaccctgggcgatctcccaggagaacctgcccctggcctttgtggtgacctttgctgtgggaaaggggaggcaggaggccatggggtctggccttggaaccacagcccgtggtctgcacctgcccacccagggactagtgctcttcccactggaggccgacttcaggaccacccgacacagcctcgccagcttcccttccaccctcggcctcccatcctcatagatctagcatacagtggctcaactcaacttgtgcctcagtcacaagcctcacggtcattgagattgcaggaaataacagaccaatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382242 - DNA, 1560 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgagacaaagtgtgtataccatgattcatctttgtgactctagcagccaaacatacattgtgccagaactttcagctacaagcattttcctccaccttcctcttttgggagaaagacgcaacagttctgtggagagcatcataattcagaggacatgcaggaacctcagccaacaacacaaacttcaggaccaagcatgatgttaacattttcaatagcagggcttgtagggggcaggaagaagaggagacaagaagtcaagactcctaatctcagctccgcatgaatggaaaaacctctttatgcttctgttattttcttccataaaagtagattggggaaagagtatagttgttcttcaaaaagtaaatataaaactaccatataacctagcaattccactcctaggtatatacacaaaagaattgaaaactgatacttaaacaaacatatatacatgcatgttcatagca

SEQ ID NO: 382243 - DNA, 1060 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagaaaaatgaaaaccttcatctccattgagaaacaaggctgaacactgtaaggagggttacagaatttaaagcagatgtgacctctactatccaagaatgtttgtttatctatttatttaataaagagtgtgtggcgcctgtc

SEQ ID NO: 382244 - DNA, 1427 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccacatcaggtccacccatctggccgggcagtaccttcttcaagagaaatggagcccttctccaagatggagtcttactcttgttgcccaggctggaatgcaatggcgtgatctcggctcactgcaacctctacagtatcctgggttcaagcaagattctcctgcctcagcctcccaagtagctgggactgcaggtgcctgccaccatgcctgactgatttttgtattttttagtagagacagggtttcaccatgttgatcaggctggtctcaaactcctgacttcaggcgatccccccacctcggcctcccaaagtgctgggattacaggcgtgaggcaccaccctggcaattacatggtaaattgtttgggaaaattcactgagctgtacacatacaagggctttgctggacatacgttattccaatagaaagtttcaaaactgattgggcagctgcaatttcattacacctatttgatttcagatttttattatgtacatgtagtgagcctcagaattcttacatggttaaaaaacaaagtaacaagaatttttatcacaattcaagcatattttataaagtctctccaaacctgcttgttattgatgttgttaatacaatatttagattcc

SEQ ID NO: 382245 - DNA, 335 bp, Homo sapiens
gagggtgggtcgaccccgggaattcggcgcgacccggcggcggggccacccgcgagtccagcgtcgccgcagccccccaatgcggccgcgagaagcagcgggggggcaggcgatcgaaggtaacgaaaatggggctcatttcctgcctcctaatctgctcgggtttagcattgtcacgagaagccctccgtgttcaggctgctgcattttggggcactctttgattttttttaaaggtgtccgcccccctatttccacctggtttcagattgatttatagcttgcagcccaaatgggaaagatccagccatggcaagttgcttattttcattagt

SEQ ID NO: 382246 - DNA, 677 bp, Homo sapiens
cacctcagggatctttggaaacgtctcttccccagcaaccagcgccgcacccggcccacctctcaccctcgactgcccagtgggagaattgctataaattccaaatcagatgctttctgaaagggacctaccaggggcttctggcaactttaagaaggaaagtctgagcaattggaggctcctggaggctgcccaggaatgcagttcagtcctcggaatttctaattcttcttcgccctgaggaagctcacaaaggtggacaagcaggccccttctcacccgaaatgtaggaagccatcagcaacctgcaccctgggcgatctcccaggagaacctgcccctggcctttgtggtgacctttgctgtgggaaaggggaggcaggaggccatggggtctggccttggaaccacagcccgtggtctgcacctgcccacccagggactagtgctcttcccactggaggccgacttcaggaccacccgacacagcctcgccagcttcccttccaccctcggcctcccatcctcatagatctagcatacagtggctcaactcaacttgtgcctcagtcacaagcctcacggtcattgagattgcaggaaataacagaccagtaagtaaatctggctctccagttcacattttttaaaaaccaagcccaggccagttgcggtgg

SEQ ID NO: 382247 - DNA, 178 bp, Homo sapiens
gtatagacaaaatctaattcaggctttgaaaaagacaccttatcacccacacccacacgtgttcaatacacctcccacctgtcctcaggcatatcaaaggtaagcaattcagacttcttttttttggtctactgaaatggcattattttggcagagacctgcgcggaaattaatttaa

SEQ ID NO: 382248 - DNA, 3035 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382249 - DNA, 3247 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagagacggggtttcaccatcttggccaggctggtcttgaactcctgacctcgtgatccacctgcctcggcttcccaagtgctgggattacaggcgtgagccaccgagcccggcctggtgctgaaccaaattacatttccaccaacaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382250 - DNA, 3106 bp, Homo sapiens
agcggcgcgatctgctgcagctcggccgggagacggcgcgacccggcggcggggccacccgcgagtccagcgtcgccgcagccccccaatgcggccgcgagaagcagcgggggggcaggcgatcgaagcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382251 - DNA, 2988 bp, Homo sapiens
gtagcttgcaggtttctgatatcgcatcagtggacaggcggcatgcactatattaacagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagaagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382252 - DNA, 2480 bp, Homo sapiens
agtcatgtgagcgctgactctaatcgtggctatagtagagggggaagaaaagtcccgaatctccaagaatcaaggtacagggagcctggcacagagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382253 - DNA, 2453 bp, Homo sapiens
gcagtgctgctctgtttggctctcttcttatgtgtgaaggttgccctcttgctagttaaaaccagaaagcttaagagtccctctctaactgcagagaacgtggctgatggcaagtgtggggaagtgtggcgccaatgtccctcatcctgagagcctcaggggtgggtattctctcatctaaaagataaatacgtaactggcctaacctgcaaggatgatgctagaggcctgggccttgtctggagagagccacaaatccgaggaagaagttgactttcaacgtccagcccttttgatgtcttacatagctggaggccagtgcacttcagtacatcagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgctgtaatttttaagcccttaggcttagagtttcttttggttttcttc

SEQ ID NO: 382254 - DNA, 1488 bp, Homo sapiens
gcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatggagtcttactcttgttgcccaggctggaatgcaatggcgtgatctcggctcactgcaacctctacagtatcctgggttcaagcaagattctcctgcctcagcctcccaagtagctgggactgcaggtgcctgccaccatgcctgactgatttttgtattttttagtagagacagggtttcaccatgttgatcaggctggtctcaaactcctgacttcaggcgatccccccacctcggcctcccaaagtgctgggattacaggcgtgaggcaccaccctggcaattacatggtaaattgtttgggaaaattcactgagctgtacacatacaagggctttgctggacatacgttattccaatagaaagtttcaaaactgattgggcagctgcaatttcattacacctatttgatttcagatttttattatgtacatgtagtgagcctcagaattcttacatggttaaaaaacaaagtaacaagaatttttatcacaattcaagcatattttataaagtctctccaaacctgcttgttattgatgttgttaatacaatatttagattcc

SEQ ID NO: 382255 - DNA, 826 bp, Homo sapiens
tgcgatctccaactttttcagttttctttgataggagagtggtcccaatgaccttttctaccattactggaagttgaagtttgatgtgtctcttgatattcccatactcatctatgtacttattgccattaaaataaaacaaaaataacttaaatgtattcaacatcaaacataacacatgctgtcatatataacaatcaagactctcatttgcaagtttggggaccccaactcaaactgacttaagaggagaaggttcatataactgaaaagcccagagacatttctggtttcgctacagtcaaatcgaagggctgtaacaaagtcatgagatttggtctctctcttcaccctttgctgcttctgttagtgtcactttcaggcaggccttcagaacctgtaaatttggcatgtcacatggcaaaggggaattaagagtgctaatcagctgacattaaaatagggagatttagaagaaaaaaaggacaaagcaaaaaatggggagagtaccttggaattttgggtgggcccaatgtaatcacaagtgccattaaaaatggaagagtgagagagaagtgtgttagagataggagtaggagaatttcaggcagatgcaacattgctggcattgaagatggagggagagatcacagactgacgagtctaggtggcttctagcagcgaagaggcaaggaagcggattttcttttagaaactccagagaagaaaacaggcctgccgataccttgatttttagcccagcgaaacttgtgtcagacttctaaactacagaactgtaagaataaatttgtgttttatctaagcc

SEQ ID NO: 382256 - DNA, 2362 bp, Homo sapiens
  misc_feature (2337)..(2337): n is a, c, g, or t
tgttaggcagcaacagtgctgatgctggactgtggcaggcagagggtgctatcctgacacacttcaccttagtgcaggaaacttcaatttggtggaagaaaggcgatttcgaggttccaatctgggcgacacttcccagttggagagtcagcaaaagggagagggcaattccaagaagagggaaaagcttgtgcacagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctgtataatatgtgtatattaaaatgtaattgatttcagttgaaagtattttaaagctgataaatagcattagggttctttgcaatgtggtatctagctgtattattggttttatttactttaaacattttgaaaagcttatactggcagccagntgagtgaatgggatctctagagcag

SEQ ID NO: 382257 - DNA, 2404 bp, Homo sapiens
tgttaggcagcaacagtgctgatgctggactgtggcaggcagagggtgctatcctgacacacttcaccttagtgcaggaaacttcaatttggtggaagaaaggcgatttcgaggttccaatctgggcgacacttcccagttggagagtcagcaaaagggagagggcaattccaagaagagggaaaagcttgtgcacagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctgtataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaat

SEQ ID NO: 382258 - DNA, 2898 bp, Homo sapiens
gcgtcgctgaggcgcccatggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgccaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctgtataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaat

SEQ ID NO: 382259 - DNA, 729 bp, Homo sapiens
  misc_feature (1)..(1): n is a, c, g, or t
  misc_feature (726)..(729): n is a, c, g, or t
nctgccccagaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcannnn

SEQ ID NO: 382260 - DNA, 412 bp, Homo sapiens
aagagacatggtcttgctctgtttcccaggatggactgcagtggcacaatcacagctcactataaccttgaactcctggactcaaaggctcaagcaatccccctgcttcaacctcccaaagtgttgggattaccaggtgtgagccaccaggtccagccaggaatcagtttctatgaaataaaatatgtgctaattactaggcatatttatggttgtgttttctattttttaggtaacatttagaggcaatgccttccaaattttattggtttttagaaatataaaatccagcatgcccacaccagaagtaaaagcattaaaaaacacactcaaaaagtagtacagaattatttcctctaaatggcctagtttgctaagattgtacaaactcagcaggtgccaaattatctaa

SEQ ID NO: 382261 - DNA, 405 bp, Homo sapiens
tagagacaaggtcttgctctgttgcccaggctggagtgcagtggtgccattatagctcactataaccttgacctcctgggtgcaagcaattctcccgcctctatcttccgagtagctcggactatgaacacgtgccaccacagctaaattttgttattttatttgtacagacaggtattgctatgtttcccagggtgctctcaaatttctgggctcaagcgatctgcccaccatggcctcccaaactgttgggattataaatatgagccacagagcccggccctgttttaaattcttttttttttttttttttgagatggagtctcgctttgtcaccaggctagagtgcagtggcgcaatctcggctcactgcaagctctgccttttgggttcaagtgattctcc

SEQ ID NO: 382262 - DNA, 709 bp, Homo sapiens
attttttttgagacagaatctcactctgtctcccaggctggtcggcagtggcacgatgttggctcactgcaacctccgcttcctaggctcaagcaatcctccagcctcagcctcctgagtagctgggaccacaggcatgagccaccatgcccagctaacttttttattttttgtggactcagggttttgccattttggtaaggctgttttcaaactcctgagctcaaagtgatccacatgcgtcaacctccctaagtgctgggattacagtcatgagccatggcacccagcctaagactggttttatatgttctttaaataggatagaattcaccaataaaactatctgtgcttgcttttctttgtggaaaatttctattttaaaactgaattatttttaatgatttatattttactaaactttaaaaaagacacttttgctttgttatttgtatttattattttcttgtttttaattttattgttttctgcttttatctttattttttctttttacaatttactttagtttttaatttattttttataggcttataaggttgaaaattaaatcattgatttcaaatcatttttttcttttaacataatcatataaagctacacattttcctttaagtactattttaactagatgtaatatctacatctagtagatattgacatattttatttttcttaacatttggtt

SEQ ID NO: 382263 - DNA, 475 bp, Homo sapiens
catgcccaccccatgcactctcacctgttactctgaggtttctctgtttgataacaaggcatagaaattcacagcaaccctcacacctgtaccatctgggagtgcaggagaatggacccattagaatgagcctttgaccaatgagatatgggagcaggggataaattcttcccgttttctcaccgaaagagacattcctgagacattttttacatggcttcattgaagataactctgtgatatcaaacaatccgttgtccttagtggtagccagttcaatacacttccttgtacctgtattggttttatctccttttctgtctcacgttatttatccttctctcccgatccttaatgtatgctccctaacaaaatcgtggcacgtaaacccttgcctcagactctactttctgaagaaaccagctaaggaaaaaatgtctctaaagaaagaaaaatagagtaatgtaaaaaaaaa

SEQ ID NO: 382264 - DNA, 285 bp, Homo sapiens
ttttatttccattacacttgggaagaacacagaagatattagtccctgcgtggcaagaatctcactctgtgagctggagtaaattttgcgtggtcttaccctgggtcaggttagggcttaggtgggaacagactagatgatgtccagaacgttttctggctcccaggtctctcagggtggtgaaaaaagaagtatgtgtagaattggtgcttatttctctctgactagcgctactgtgacacccaacaagtcccaaaaatccttagggtgctcatttacagaaag

SEQ ID NO: 382265 - DNA, 231 bp, Homo sapiens
aaaacttcacattaaatttaaacaaaaacattcaaataaaagtaaaaattctgatcagttttcttatgcatgccacaagacacatacagttaggttttaacctgggagaaaaaaacattccttcacccatgtccctactttgcctcttctagtaatctcaagcttggtccaagactaacatcaccacaaataagtgaggccttttctggcaccagcccatgcacatttagg

SEQ ID NO: 382266 - DNA, 341 bp, Homo sapiens
tgggccttcccttcaggtgtgtgtcagtctcctctaatgatcctggtccccactgtctgcccctgcccgtagcatctccactaaaggaaagaaatgataggagggatgggaatagaggcgagatgatagacctgctgttcagtactgtagccactagctacatgtggctgttgggcactggaaatacagctagtccaagttgagatgtgcgtaagtgtaaaatacaccatgctttgagactatataaaaaaatgtaaaatttcttatttaacaaattgtaatattggttacatgttgaaacagcaatagttttgatatagtaggttaaacaaaatatatta

SEQ ID NO: 382267 - DNA, 636 bp, Homo sapiens
ataattttctatgtcaaattagtgtcagtcgcccttttataccacagttttcccgttcgtgaatttttagtttaaacttacctctcaattagctgagtgcctcactcaagcaatcttttcaagaagggtagccgggcatggtggctcgtgtctgtaatgccagcactttgggaggccaaggcgggaggatcacttgaggtcaggagttgcactccagcctgggtgacagagcgaaacttcatctcaaaaaaaaagggtagcataaatgctattttaccttagctcatgtacacctgataatttctttctgtgctgtcacacttgagtagggcgtactttctttggggcactaactgttccactcccaattttgtaaatactactccactgactcttgcttagtatttaggattatggagaagtctgaggccattctcagactctttctcattctctttttgttccgttatcattaatgtgttttctctgcctagttgtcattaattgtatacctagaacatagtaatagctttccatctcagaactggttatttattttagatcaagaatattttattgtattatgtgtctgattactgtttctgatccatttatcgtaagttttttgagaactct

SEQ ID NO: 382268 - DNA, 384 bp, Homo sapiens
tttttttttctgagatgggtctcactctgttgcccaggctagagtacagtggtgtgatttcagctcactgcagcctttatctcctgggttcaagcgatcctcccacctcagcttcccaagtagctggcaccacaggcctgcagagccatactttgtcctcctctgccagccacagcctgatacctgcaacacagttcccagcaaaccccccactcccccttaccttgtgagccacagcaaactaaacctcccaacttcagcagggaaaaaaccctcaggaggatgactagagtgatccctctgtctaaataccaccttgttcctctaaatctactgcaaatatttccaaacatttcctcccttttcccagtggatatcctagac

SEQ ID NO: 382269 - DNA, 2768 bp, Homo sapiens
gctcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatatgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctggtgtacagaaaagattatataaaatttaaatccacatagatctattcataagctgaatgaaccattactaagagaatgcaacaggatacaaatggccactagaggtcattatttctttctttcttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgggagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaagccc

SEQ ID NO: 382270 - DNA, 2857 bp, Homo sapiens
aacagtattttccttttcaacacatctattgaaagtgttggataaatgcaggatgttaatatgctataaacataaagtctgtttttaaaaaatagcatttgaaaatcatgaagggctttttgttttcttttgtttgtatatatgtttattggtaacaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatatgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctggtgtacagaaaagattatataaaatttaaatccacatagatctattcataagctgaatgaaccattactaagagaatgcaacaggatacaaatggccactagaggtcattatttctttctttcttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgggagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaagccc

SEQ ID NO: 382271 - DNA, 954 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaagacaaggttttgctgtattgcccaggcgagtctcacactcctgggctgaaatgattctcctgcctcagcctcccaaaatgctgggattaacaggtgttcgctgccatgcctggcctaggatgaataaatgactttcgatttagctgctgttacttaatcatttgttttatactgtttaaaaataaagaatgttttagcagaag

SEQ ID NO: 382272 - DNA, 738 bp, Homo sapiens
gcatcccagctactgctcaggtcgctctagagatcccccgttgacacttacggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctctatcagctacctcctcctccccagttctactggacca

SEQ ID NO: 382273 - DNA, 603 bp, Homo sapiens
tgcgctgtgtgggatcctctatatgccagagctcgcaggctgctaggcttggtattgttcgatctattgacaagtgtcatgagtgatactacctctggttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatgagatgtaggaaggcctaccaacatctcatttcttcatttatagcatctcataactaattttctaaagtttggatagggacttatcaggtcctttttggagggcaaggaagtgcagctactctggggaaactgtaataaatccaaagacttgaaccacattccctgcacatgaacatgttgcttttatcccttctctcatgtctccttcccatcttagacctgt

SEQ ID NO: 382274 - DNA, 5056 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382275 - DNA, 5363 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382276 - DNA, 4999 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacaggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382277 - DNA, 4589 bp, Homo sapiens
tgcgaaattaggttacttattgttttggttattaatgaacaattgccaatgtgaatgaaatcttttgttaaattataagggaaagtttcacatgcagcaaaataatacagaaaatgtttttataaatttttataaaacttgaatctttaatgtttgtttttaccatttactgtattgttggtctttttacatttggccatagttctatgaaatgtaaactttttcaggaaagccatgaaaaataatttagatagttatttcttaaacatgtgacttgtgatagttttgatattaaagacctttatcactccacagaacatttttatttaaactttaatacagttgaccagaattgcaatctaattaaatatatcaatttgttgactggctgaaatttaagatcctttcaatgataatcatatcaaaattacttcttttggttcaattatatttaccattacataaaactacaaaacatttggttaatctttccgtgggtatacagtgaaataggtagccagaccaacacctctttattttttattgggttgtttgatgagctgttctacttctaaaagatttaatcttgtttcattctaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382278 - DNA, 2487 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382279 - DNA, 5482 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctgagctgcttcattgttcatcaatccaatcagtttctcctctttctgcactttccatgttgcacaggactcagcgcttctctcactgtggacttttttttcgattaacctattgtgtgccttgttgacttgctttgttgcagccttttgtgaatcaactttttgactgtttggagtatggacatttatactctgtccttttgtggaaaagtccagtggtcctaaaggtattccatgagggttcaa

SEQ ID NO: 382280 - DNA, 5293 bp, Homo sapiens
  misc_feature (5221)..(5221): n is a, c, g, or t
  misc_feature (5281)..(5281): n is a, c, g, or t
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgataaatcttgtncctggtccccacaaagcggcgtaaaagcggccctcacccctcctctcctcttgggggaanacactcaactct

SEQ ID NO: 382281 - DNA, 697 bp, Homo sapiens
ctagaggacccatgcgcgacgcttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382282 - DNA, 1159 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctctatcagctacctcctcctccccagttctactggacca

SEQ ID NO: 382283 - DNA, 930 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataattttaaaatatttttcttgctggcagccaccagaaactggaagaggcaaggaatagattctctcctagagcctccagagggagcacatctttgctgacaccttgatttttgcccagtgaacagatgtggaacccctggcctccagaactatgagagaataaattcctcttgttttagcca

SEQ ID NO: 382284 - DNA, 2047 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382285 - DNA, 3714 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382286 - DNA, 4879 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcaggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382287 - DNA, 5298 bp, Homo sapiens
  misc_feature (5278)..(5278): n is a, c, g, or t
  misc_feature (5280)..(5281): n is a, c, g, or t
  misc_feature (5292)..(5292): n is a, c, g, or t
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttgattggttgttaagtacaactgtctcttggaacagggggattgatttcagggctgcccatggatacaaaaatccacagacattaaagttccacagttaccctgcaggacccatatatagaagaagtcggccctctgtatacagagatttcacataaacacaggttctgcatcttgtcagtactgtatttttgatctgcatttggttaaaaaaaaaatctgtgtataagtagacctgtgcagttcaaacccatgttgttcaagggtcaactatatacttttttcatggtcttcagtagtgacgtcattaatgacagacatttattaaaaataaggggagaactccaaagtagctaatgagatgtttggcttttctacatagtctgtttatggatggctcaaatactgattagcttgatgtaagtgtttgtgaagcagttatagtttctcaaaattgaatagataccactatactgcaaaaataatagaattgatttttgacaaggctgctaaggttgtagactactaaatggtagtgagtttctttttcctttagttacagaattgtgctgtttagtaatcactagctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattcccagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatccaatactactacttttcatgttgagaagaatgccttttgtgatctgagtctcacagcactcaggcaatgccactttacttactgtatgtgaagtctactttcattcctgtctttagtgcctggcttcaccttagggcctagttgatacatgataaactgtgtgtaactatatacagaacaccttgcaattgtatgttgccttcggtttcagtcttccttaatatcacatctttacttttgtgattagaggtagcagttggtgccgtctgtactttgccaatggagaacttaggcagaggcatctatttaccttatataaaatcatgaaattacagaaatacaggtcaaattacagaaatactctaagggaacatgtgatttcttttgtaattatgaatattcatttaatttttaaaaattcactggctcatgcttataatcaatgggttgaaaattaacccactgttagtgattcagaccagaactaagagggaaattttcaagagcctgtagtatctttaacagcaggagttgttaatttgtgattaatggatttagggaaagtctatgaatgccaggaacttagtatgcattatttttatgtatgtctattctggggataaagaaaatgcgtaattcttatcagattcttaaaggggcccataatctggttataaaccagtggtttaggccttcaattccatgttgatttcccttgttactcaacatcttaatagtctgctattggctcaggaaatacatcccttactcttgcaaaacaaaattaagctaagtcttctggaataaaaacataatgcacttaaaaacaaagggaatgacatttggagtatctgtaatttgtaatcatgctgacgcttctcctttatcttttaaaatttgcagtggctgagaggactactaactagtagacagagttttaacatcatatttggtgaatgtccatattgtagtaaggtaagcaaattgttaatcacatctcataaaatgtgcctagctttcagtaatatgttctagaagatagatctatatagtatatcagtttatctaaaacttttgaaactcattctctgtatttctatttttcaaattctctgatcaaaaacattaaactccttttctagatttcctaggtgatctgaaacttcagaagtgttttccaaactgtactatgacactattctatgacactatttctagtacaaagcaattttattttttagagtgtccacaaactttgttaaaatatgttctctttttaaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgataattcaatattctacctggcgtacgggagatttatttaggacgaaccggaagaagtgaagagagggngnntggggaggggnttgtgg

SEQ ID NO: 382288 - DNA, 1603 bp, Homo sapiens
acgtccaggctgtaaaagtcattttattctggaggaaatgcaacaccaaagttgtaacagtctttcaataaagtaaaacagaatcatcgaaagggctcctgggacaattgaggctagaatgatcttggtcagtcagtcctgtggacttgagggcaatcttccctcccactaccggttggggagccctgatgtcgcctcccgcagagcgccacttggcctggcctgcgcttcaccttcatttccgcccgcggaatcctccaggatcttcccgccaaggctggggtttccgctccgcggcgtccgagcgccagcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaattgcgtgttatttttcc

SEQ ID NO: 382289 - DNA, 481 bp, Homo sapiens
ttgccaatagatggcaccaagaggaatgcccccaagtagagtttgggcaacactgaaggctctagatttccccagaccttcaaaaaagcaacaaggtaaaccaggattgagactttgctaacttctagtttcttcccaagacattaaaaaaaatggtgattgagagtagactttcctaacttggagtctgtaaaagaacttctggtgtagagtctgtatgttttctacaataatctatgcatattcctgggaaggaattgcctttcactagattttcaaaaaggttcttgatccaaaaacatattcacaggcttcagtaatataaatcaaagagagaaatacataatgtgtgtgttgaagacattttgtattgctgatgaaaagctataaagctgtgaggctgggcacggtggcctaaacctgtaatcccagcactttgggagtctgaacctggtgtaacacgcgagctaggacgaggttt

SEQ ID NO: 382290 - DNA, 442 bp, Homo sapiens
gctgaaaggaccaattaagaggctcccatgacaattcaggttaacacacctggtctaggaactgcaaaggagagggcagaggaaagagctctcccatgaccaaaaagttacagagccttttctggtatggagacactgattgtgatcccatcttcagagtacatgtggctggaagaacaactgcagcaacaggaggggcaagctctctggaaaaagctggaggggaaataatgaattagatcttggcaggtgagtttgagtctaccatgggcagaaggatggcagcacagcaccctgatgtagacgaccagcaggtagactaactttgagtccagagccaaggagacgtcaacctgggatgtactgattccagagagccacagaggatcccctgccatggatgccacacttctccccacaatacagcacttgccagaggtgc

SEQ ID NO: 382291 - DNA, 1710 bp, Homo sapiens
gacttccgctttgaaggcgaggaccccagcgagcgtaagggcgcagtgtccgcctggcggatttgggtcagcaggcggaagtcgtcccaggctgctagatactaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatt

SEQ ID NO: 382292 - DNA, 3550 bp, Homo sapiens
  misc_feature (995)..(995): n is a, c, g, or t
  misc_feature (1684)..(1684): n is a, c, g, or t
ttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactnctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagaganagtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggcgaggacccgagcgagcttaaggccagtggggtgcagcgtctggtcagccgagggtgaattctcaggactggtcgggagtcaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatt

SEQ ID NO: 382293 - DNA, 2146 bp, Homo sapiens
  misc_feature (995)..(995): n is a, c, g, or t
  misc_feature (1684)..(1684): n is a, c, g, or t
ttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactnctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagaganagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtagagaaaaaaaaagtaaa

SEQ ID NO: 382294 - DNA, 3465 bp, Homo sapiens
  misc_feature (995)..(995): n is a, c, g, or t
  misc_feature (1684)..(1684): n is a, c, g, or t
ttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtgcaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactnctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagaganagtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcataagagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatt

SEQ ID NO: 382295 - DNA, 384 bp, Homo sapiens
aaactctcacttaaagtcagcagttaaaagcagactccacacttgctacaaacagcagtagtgaaggaaaaggctcggtgtagaaataaatacagagtagcttaaatgccatgaggaggggggcataaaaaaattcaagaaaatgtatatagagtaataatttggggtggaaaaacaggtaatggtcacagaaaagggagaagaaagtgtggaaagattattctgatgagcttactttctcttctagccctcagattatattagccatgaaagtaacaggtcatggaaatgaaatgtgtacatgatgggtgcattaatttgcttcactacagtaacctgtttactgtctatatttaattcataacatcatgttgtatgccttaa

SEQ ID NO: 382296 - DNA, 343 bp, Homo sapiens
tagctcccaccactctcttggggttctctcccaggaaaacagctcatttctgcatcagcccttcaagcagactgcgctttctccactcttccttccctttcccactctagggctgtgaccgctgagcctgatagaaatgtatctccagctagcagataaccatggctcaaggttagctctctgtgagtcacacaatagcaaaaggccctgggtgagccaagagccatctggagcccaggcgtagggaaaaaccctgacaagttgcagacaaaggacaaagccaggcctcagggtggaaggaggaggtctttcttttttttttttgggacggagtctcgctctt

SEQ ID NO: 382297 - DNA, 752 bp, Homo sapiens
ggcaaggacttattcaaagtaatgtagttttattttatcctcatgttcaccacagtatctcttgctctcttagtttgagggttaaaggtacttcttgttggagaaataagaagtgagctgatgaagagagaataaaacctggtagattgctatctgcggaccttaatcctgtttagaagccctaacttaactctgaaggggatactgtctcttttaactcttgctataatcatttgtatggaaggtagataatactgataacattgcctgatttctctgcgtattattacatttaaccctttgaggccttgctgcatataatttcaactaggctgttttttccccctgactaaatttaatctgcggcactgaagcatcttgacgtgcagtcattaaaatcatatggttttattggcagcaagagctgaccctcatctgtgacattttcaaagggttagcaagacttctgtagctacctacctacctatctgtaaagtagctcttctttgacattgaaaatctttgtattttaattagcacctttttttttttttggctgcttttctgatgtctttttttcaatttagacattttctgtgtgaatgtgccttcaaatttactttagtatattcctctgcaaatactgatctgcatgcttattctgatgacttcttttccagctcttctgtatcactctcttttgtgatctgtaagtcttgtgttaataaataattctttggcatattttgaaa

SEQ ID NO: 382298 - DNA, 442 bp, Homo sapiens
gctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattca

SEQ ID NO: 382299 - DNA, 546 bp, Homo sapiens
tgttattggggagttgcgtttccctactattattgcgtggctacttgagtcttattgtaggtctagcagtacttgttgtataactctatgttccccaaagttgggtgcatctacatttaggatagttaagtcttcttgttgaattgaaccctctatcgttatgcaatgcctttctttgttttattttactattaatgatttaaagtccttttttcttaaaagagaaacaattccaggtatggtgctcatgccagcactttcagactgaggcagtaggattgcctgagaccaggagtttgagaccagccgaggcaacataacaacattctgtttgtacagattcttttaaagaaactatacaggtgtggtagtgtgcccaactgtggtcatatttactcaggagacataggaggcatgactgctttacttcagaaatttgaggttacagtgagctgtgattgcaccactgcaatctgtcccaggagatagagtaagatcctgtgtataaaatgaaaaaataaagaaaaataaaatgattttaagtta

SEQ ID NO: 382300 - DNA, 496 bp, Homo sapiens
atggtaacatgaattgactgagtacatatcaagtcttacactgtatacttcacatgcactaactctcctactcttcacaacaagcatgcaaggtgggaaaatagaggctgagagaaattgagtaacttgcctcaagccatatattcggcaccgagatgtgatctgagccagagccaacaactgaggtccaaacagcgtgccttgcgcaaggccacacaagagataatggcattggctgtaccagtggcccagatccttcacctgcagaagagcttcccagagaggagcaagccttcctgccgtcacctctggtgtcatcctataggacattaaaaccaactcaagattgtgttgaaaactgttttccttttgaggatgctaataagaacaagatcatatcaacgggtatggatcatggcaggattttccttcagctgagtcttttaatgagccgtttcataatgagggctgaatctacacacagtatctacatgct

SEQ ID NO: 382301 - DNA, 234 bp, Homo sapiens
ggtcacagcaaaagaagtaaatgtaagttacttagattttccaaaagcctttgataaaattccagtcagcagttggaggggaaagcacattatgtaataataactgggaaaatgacttttaagaacatgaaaaataggctatgcatggtggctcattcttatgtataatcacagcaccttgggaggttcaggtgggaggactgattgagcccaggagttggagaccagcctggg

SEQ ID NO: 382302 - DNA, 436 bp, Homo sapiens
aaatatgtgctgagtcttggatttgcatctttatcgtgactccacggagacccaccctctaagaccagagccagtgtcctattcatcttttgtctctgcagcgttcagcatggcactgtcttggcttacaaaatctgctctatgcttgctgactgctgaatgaatgaatgaatgaataggtagtcacaaagaatgtttagaatgtttctcagacaggctgagaaaaaacacaacgaaacattatttccgtttggaaagtttttttatttttgtgttcagtactgaagtaaaacaaaaatctgaataacagctgcaccgttaaaaatgaaattaccaatatatgaactctaggcatcatgcatatataattttttgtagataacttttcttctcattttccttctcattctcttcatctttttctttttgtttgagc

SEQ ID NO: 382303 - DNA, 819 bp, Homo sapiens
tcaggaaggaaaaaatgcagctgttcttattgcacatcaaatccacaaggaggaaaatatgccttcttttcaggagtcaggctcgggcttgcaagtaaaatgcacaggccttcttcctctcagttaggagagcaaggctttcgctgtccccagaggtctgcccgagactgaagccctctgactcttgacctcagtgggctctgccaggcttcctcatgcattaggatcacctgctccacagtgaaacactcactatcaaagttttcccgcaacttctgagcaagcgaataaattcagctctagcacactctcaggtcaccctgagtcctctcactcccatgaccgaacatgtggggcacgtgaggtcctgagtcttgaaccctgctctatggagcagagtttaatgagcgccactcatggcgggcgagcgggtgaggccaacccctaggacgcaagagcgcagaggagccgcggcgtccccggtacaggaaacgcgtccccacggctcgcctcctgtgccgcagccctagcagaacagctacacggcactcatttgttccctttccctagcttgcatagcaacagcaattgcacaccccatagatgattttgatggttatcagagtcctccccagatctgtagcgaaacagccctatcattcccaaagcgagatcttcattagatgcagacaaaaaccgcaaaatgtgaatgaaatgctgtttgtgtgaatgaaaaggctagcgagcgagccagcgtttctgtgaatgaagcagggccttgcagccggtgccaggcaatcccctgggctccagcggcct

SEQ ID NO: 382304 - DNA, 538 bp, Homo sapiens
gtcctaatgttgaaacttgtttggcttcctagactaaaccaagcttaattgtgaagtaatattcattgtaatacttaactggatgcaaacactaatgagtattttattatctgtgatatttgcacctgttttcagaagtaagatatctatacttttgttattttgttttcattttttgcttctatcttcagttttgagtatctaggtatgctgacttggtataatacattgggaagtttttcatgtttctctatgctctagagcagtttcttaatattgaaatgttctcttccttgaagatctgggtaaatttattctataaaataatctgagtagatccttttgtagcttttcaatcttttgtattgttttgggtttgtttacattttccacttcttcctgagtcaatgttggtgattaacctattctcgagaattaattcacccatgcttttcaagtgtatttcataagtgtgaacacgatactctcatatttaaatatcctttgtatctgtatatgtgttattttctttattctt

SEQ ID NO: 382305 - DNA, 460 bp, Homo sapiens
caaagtggatgaagcgagcagagcatgggatgggaggagagaggagaaaacctgcctctgaaggggtgatgaattagggtaaacccctaagagatgagaaggatgagagggtgaaaagcatcgccaggcacagggagctgcatgtccaactgttcctcaggggagaaagtttggccttctctaggaacagacggagagaaggcaagggatcctaagggagatggtgcaagggcttttggggagtttggggtttatccaaaatgtagtagagaagagggttcttgaagagttttcagcagggatgggacatgtgggatttgtgtaaagcagggagcaaactatggctcaagggcctgctttggctcactgcctgtttttggaaacaaagttttattggatcacagacacaccattagttttcttaggagctacaaaggcagaatttatgaaaaaagaaaat

SEQ ID NO: 382306 - DNA, 415 bp, Homo sapiens
ataaacattcatggccctggaaagaaattaacgcttccatagtttgagggattccaaaatttcctttttgccagttcttactcctgggtgtgatctgttatagagtacggagggcagtacagaggactggacttgggttcttgcctgtttcctgctgcattgttgttctgtgatttggggtctcgtaagaatttttctgagttttttctttgtaagagagggatcagccctgtcatacctaccataaagaattgctgaagctcaaatcagatcgcttaagtaaaaatgacttgaaaagcccaaagagatctataatttttaggacaagaaaaaatgattttaagaatttttttgaaaattttagagcattccttgaaaataactagaagaaccctggggcactgcaaaaaaaaaa

SEQ ID NO: 382307 - DNA, 339 bp, Homo sapiens
gaagaaggaggcatcttggctctagtggacaagggccctgagctttacacagccctccatatttattaggcaaaagagatagtgagaaggcgggtggaagaaggggtcagctgctcagtctagagtaggcttgcaagactgcattccttgaacaaaaggttctagatgttgcagtagagaaccttggcgccagggagtgattgcctccagcaaaccttctgttggcaggagcagtcggccggagcagtcgtgagtttgctcatatcctgcattcatgatgaacggtttgctgtttgatcatatagtctccaggggaatgctgagttggtcacgtcccat

SEQ ID NO: 382308 - DNA, 427 bp, Homo sapiens
caagttttttacatctgaatatatacatatgtacatatggctttggcatggccgagaaaaagaatcgataagcaaattcttttatgtacttcctataaaagatacgatacataagacagtttttattttttttttttctctctctctcttccctaaacagtcccgaggccccctgggtgctgaaggcagcaccgcagtgcaacgtgtcctctctcggttccatttctggaggagctgatgcaattccaaggcgcggggctgggccagagctcggttcttgtgctacagtagaatagtgttccagcgtggctgcctctgcagcgcctggcaattctagaaattttgccatctgcagctcagctcaggaatactgagcttgcagccatcagctttgagtgccattatctgaaccggccctgcgtgccag

SEQ ID NO: 382309 - DNA, 4838 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggt

SEQ ID NO: 382310 - DNA, 3463 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccacc

SEQ ID NO: 382311 - DNA, 222 bp, Homo sapiens
aattcaagcttctaacgatgtacggggacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggt

SEQ ID NO: 382312 - DNA, 5516 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382313 - DNA, 4568 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaaacaaaaagtcgtatcgatgtcgagcgatc

SEQ ID NO: 382314 - DNA, 5688 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggtgaggcctggggaaggaggctgctacatggcctgatctgccacaccacagtcagcacccccggggagctgtgctccctcaggcagagcatgggttttggctggtggggcagaacagatgggggactctgagttcaggaaccttctccagcctttctttggtgtcccctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382315 - DNA, 5473 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccagcagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382316 - DNA, 3432 bp, Homo sapiens
acagatgtaaactaagacgtcgatactcgggtgtaatttcatacgaggccagctttgctgtaggtaccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382317 - DNA, 1869 bp, Homo sapiens
agagacagggaaaagctgtaagttagaaatgaagtcagggtgtgaaattggtggaaaggtgtgagcttaggagaccagctggggcagagtgaccgccaagccttgctctccccatctgtgccattgtaagaaaagatggagtcactccctgcaccctcttcgctcttaggtaccataagatctgtcccccaactctcccagatctgtgaccccacattctctctccataggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382318 - DNA, 4222 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagaaatccgacaagagaaaaaaagacaaag

SEQ ID NO: 382319 - DNA, 1528 bp, Homo sapiens
agaccccacatgcccaaaggcctcgggacttcccaccaccttgcgcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382320 - DNA, 1681 bp, Homo sapiens
agagacagggaaaagctgtaagttagaaatgaagtcagggtgtgaaattggtggaaaggtgtgagcttaggagaccagctggggcagagtgaccgccaagccttgctctccccatctgtgccattgtaagaaaagatggagtcactccctgcaccctcttcgctcttaggtaccataagatctgtcccccaactctcccagatctgtgaccccacattctctctccataggtggaaaagaggctgcttcaggcaccacacctcagaagtcccggaagcccaagaaaggggctgggaacccccaagcctcaaccctggcgctgcaaagcaacatcccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382321 - DNA, 1346 bp, Homo sapiens
  misc_feature (91)..(91): n is a, c, g, or t
  misc_feature (105)..(105): n is a, c, g, or t
  misc_feature (122)..(122): n is a, c, g, or t
  misc_feature (134)..(134): n is a, c, g, or t
  misc_feature (141)..(141): n is a, c, g, or t
gggggggaaaaattttttccgcccccccccccccttttcccccccttttttaaaaagggggaaaaaaaaagggcccccccggggggggggnaccccccccggggnccccctcctttaaaaancccttttaaaantccttcntcttaaatagcggcgtgcgaagaaaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382322 - DNA, 2685 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaactcagtaagaaccaggcaaggcaaccagtgcgcagaagacgtcagaaaaggacattcaccctgaaagtgtatgggtgtcagccagcaacgtcaccacggactcggaacccccaatagagctggccgccgagcccggaaggggccacaccgggaaagctcgcccagcaagaaaggacagaaacggcgccagtcaggaaacagaaaacgccaggtgaaagagatgaacacacacaaccagcgagtag

SEQ ID NO: 382323 - DNA, 642 bp, Homo sapiens
aagggcagggagtgttgccccatttgacagattgggaatcaagccttagagttgaagcagtttccccaaattctcatgattcataagaggctgaggaaaggtccaaacgctggtcccctggctccctgtatctctctgttttctgtttaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattaca

SEQ ID NO: 382324 - DNA, 337 bp, Homo sapiens
tttattatgttccagacatcatgttaaactctgaatctcctatttagtcttcatcataacccgtaggtgggccttattattatctccatttgatagaggactgaactgaggcccagtgagatcaagtgatgagctcaggttcacacgcctattgcatggaggagccagaatccagactcgggctccagctccagagtctgtattcttggctagctgctttactcaatctcaccttctccctccttaattcccttttctccactcaggtgaaaacctcagtaaagaaaacccaggccaaagccaacccagctgccgccagagcaccttcagcaaaagg

SEQ ID NO: 382325 - DNA, 164 bp, Homo sapiens
gaaaaaaagacaaagaaaaaaaagaaaagaagaagaaagcaaaaaaggcctcaaccaaagattctgagtcaccgtcccagaagaaaaagaagaaaaaggtagagagttcctggggtgtctcaggccagaaaacagacccaaacccaagccccctcctacacacc

SEQ ID NO: 382326 - DNA, 390 bp, Homo sapiens
cagaaggggatggggacggttgaaggtggagatcaaagcaacccaaagagcaagaaggagaagaagaaatccgacaagagtgagtgaccgcttctcccagcccaccccaagggctgctgggcaccccacgggggcgggagggaccctcagccagcacctggtctcattcctcccatgtagaaaagagaggctgagaccagcctggccaacatggcaaaaccccgtctctactaaaaatacaaaaaattagctggatgtggtggcgggcacctgtaatctcagctacatgggaggctgaggcaggagaattgtttgaacccgggaggcagagcttgcagtgagccgagatcacgcattgcactccagcctgggtgacagagcaagactgtc

SEQ ID NO: 382327 - DNA, 165 bp, Homo sapiens
ttcattttccttgcaggggaaaagggtcaggaaatttgacatctgcatgtgtttccttcccctagggatttcctagccgagcagtggccatccccatgcctctgacctccaccgacctctgcccaccatgggttggaactaaactgttaccttccctcgctccac

SEQ ID NO: 382328 - DNA, 1652 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaagaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382329 - DNA, 462 bp, Homo sapiens
ccccacccccgcctgccccccgctctctcacgcacctcacctcaccatcacagctctcctacctatacacatcaagaccctagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtaaaaaaaattcactggccgacgttttaccgtcgtgctgggccctgc

SEQ ID NO: 382330 - DNA, 4621 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagccaagggcggcaggaaaaagaagaagaagaaggcacccaccccgcaggagaagaagcgcaggaaagacagccgcgtagtcagat

SEQ ID NO: 382331 - DNA, 5402 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382332 - DNA, 5381 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggcagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382333 - DNA, 3226 bp, Homo sapiens
tccagttttgaaatgccatgaacaaaagttgcccttttttggtgtttgtaatagtgacttcagcattcttccaagcctttaccatcttcagtgcatttttatttggtccttgcctgaatctaaaagctgggcattttagggttaatggctggtgcattgtttagatcataaaacttagcacacatccccaccccaagggctgcgatgtgaccagcattcagcaaggccggaacccgggtcttctgagacccagttcattgctctttgggccatatcagtctggtttcccatcccactgagaggatgaagtccatgacacactctgacctctcttcctgaggggtgggctaagggggtgttggggggcggtggggctggtgtgccacccactccctgggctcatcacaagctccaggtcaaaaacttctgggaacatgggtgtcggatgggaagtcaggctgtggtcactgcatccatgagcatcggttcctgccaggccctagggatactgcaggaaccaagacagggacaaggaattcccaggccagtcagggagtggtggggacagctggatgaggagctgggggagaggagatgagccaggccgtggcaagagccacgccacatttgaaggctctcagcaaggggtcatgcccaatttccatgcccaccactctccctgactgctagtggttataagaagtagagatgggggtccaccaggttggagattatccccagtgaaggtgcagattgagtagtggggcctaagctgcttccctgccctgggctgggaactgtcccttgctccttgagaacaatgtgattcgctcataacctgaagcctgccaccagttttgcccctttgactgcccctcagtccctgctccagccctcaccccagccagacagcatctgaccagggtgtggcacagctggcatcccaaggacttgtgagtctgagggctacctcttgccacccacaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382334 - DNA, 4466 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagagaagacgacagaaggggatggggacggttgaaggtggagatcaaagcaacccaaagagcaagaaggagaagaagaaatccgacaagagaacaagactaattaccgggggtagat

SEQ ID NO: 382335 - DNA, 2058 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagaaaggacgagccagaagagaagacgacagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttg

SEQ ID NO: 382336 - DNA, 3846 bp, Homo sapiens
  misc_feature (5)..(5): n is a, c, g, or t
agtgnggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccaccaccaacatcggtaactccctgtattctcatttttctgtttaatctccacaacagccctatgagggtggctccctttgttgtttgcattttaaggaactgggagtgaggctcagagaagttgagggacctgtcccagcatcacatggctgatgacaagtggacagacctggtgtttgagcacaggccattcacattctgacccgttgcctggtgctgccccgacactctcctctcctgggcttgggcattgccctctggctctgtgtggagcctttacgaggccacctgcctctctgagggatctaaacaactgggagggaggggaccgctccccctttctctgtgggggtggactaacacaattaaaatgaacatcctgctta

SEQ ID NO: 382337 - DNA, 144 bp, Homo sapiens
ccaggctgctttcctcacagcaggccatgactcgggctgggttatggcagtggggtggggtggtggcagcctctttcacaatgggcttcttcagtctctcctctcaggttatatgacccctggactaaccccagccaattccca

SEQ ID NO: 382338 - DNA, 1511 bp, Homo sapiens
aaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaactttgggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagtttactgcccgtgaaatattttactggatacaggcgtaccttgcttaattgtgcattgcagttactgcattttatacacactgaaggtttgcagcaaccttgcagtgaataagtctatcagcaccattttccaaacagcatatgcacatttcatgtctttgtgtcacactttgctagttttcataatatttcaaactttttcattgttaaatctgttatggtgatctgtgaccagtgttttttgattactagtgtaattgttactagtgtaattgtttggggataccacaaatcctgcccataaaagatggtgaactagttgataattgttgtgggttttgaaagaatagtaaaatatatacacatatcccccccacctagattcaaaattgttaacaatttgccacatttattttttgtatatttgttgtaccattgagaataagttttagaccattgagaataagttttagatatcatgacactttactccttgttacatcagcatgtgtgttacccaaacataaagacaatatcatataaccatagtaccataattacccttaaggaaaatattcataattctgtaatatcattccatcttcagatttcttccttggcctgcaaaccatcttttacagctatt

SEQ ID NO: 382339 - DNA, 411 bp, Homo sapiens
tgcaaataagtagtagggagcggaaaatgtaagaattttcacctgaaaatggatctgaagagtaaaagatattaattgacctaatcgtgcattgagaattgactgtttatcccatttatttgttcaataaataagccaatgggttgtaaacattgtaaacattccacagcatgtggaaaggacatggatttttggagtcaaattgaatctaagccttgctacttacttacctgtaatgatgcaaccttaattacttgatctctgtaaacctcagtttccttacctacaaaacgtttgtactattacctgccttatagagaggtccagacttaagaatatgatgatgtaaatgtttggcactgtgtctggcttttagtaagtggtcaataaaggccagttctcctttcctta

SEQ ID NO: 382340 - DNA, 615 bp, Homo sapiens
gcagaggaatgtctgccaggcacggagagcagccggctccctgctgcccagtgcagcccctcaccctattacctgcccgggttagctggaggattgggtgctgggtgggtgtggagagctggtgcccaaagtggtttattttttttaaacaggccacttccctcttcttggctttggcctttcacctccataggccagtggttctccaagtgtggttccctggccagcagcatcagggacatgttaaacatgcaaattctctagccaccccagacctactgaatcagaaactctgggggtggaatccacccattgtgttttttaaaaacaactttatagaggtataatttacatatcataaaattcacccgttttaagcatactagtcaatggtttttagtaaaggtattgaattgtgcaactgttgccacaacccggttctagaacatttctgtcatcccaataagatcccaggggtcagtttacagtcagtcccctccccgtcccctagccctaggcaaccaccaatctactttctgtctctatagatttgccttttctggatgatcttttgggtctggcttctttcacttagaataaagttttgttaacagc

SEQ ID NO: 382341 - DNA, 306 bp, Homo sapiens
gataaacttgagccaccaagaagtggactctgcctaggaagacagtttgctgaagttagaaagtactggtctaggaaccagaaaacctgattctgcccaagagttagaattgtgagtgagttctttctggtttttagtttccttatctgtaaaataattacccagttcaattggataatctctatgatcccttccacattctgcatacttggatatctactgtttctaaatattttggcatttcttataaagccctttcacatttactttattattttttcctcacaagaattcctgaaatagata

SEQ ID NO: 382342 - DNA, 654 bp, Homo sapiens
gtagtgctctggtgtcactgactcagacatgtgggggcttctgccacccacgctcaagagccactttgccgtttcaccgtctctgtgtcctccacagccctcagcagcatgcacgccaataacatgttcaccacgaggctcaaatctcagcagaagctacagagtccaacatccaggtaagggaaagtgcagggcttctcgggtgatgctctactgattttattttaatgaatgaaagaccagaagaagtcagtctttgaagggagaggagaggagcatctgctggcattagcagccatgccatcggtaggactggctcacctggtaacctgtggccacctgtgcttttacatctactcttggttaaccacgggccacttttccagcttggactctaagcgtctgttccacttcctctccttcctcattgaactctttcactaaaaggagagtgcaagagagacttaaactgtttgactcattcttaagaactttcaggaaaagtgttggcagggaaggaaatttcccagctctgggaaataagccttgtggattatctgcaggtttcattgatctgtgctgtcctccccacatgcattaagaaaattggccttggttctaataagaacagcatttgtcctggtgacaaggaaa

SEQ ID NO: 382343 - DNA, 3732 bp, Homo sapiens
gacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaaaaagtcacgctgggcccctctctacagggggacacacaggcttagtttagtatatgtctaaccagattttgcatgtcaagcatttgtccttttcctggcttatgttttcttgtagaaattatataaaccctatcaaatccactactaggtaaatttttaaaccatgcagctttattactctcctcccccaaagaatgtagtttgaaattttctcatttccatagtagaggccctaactgccattgtattactaataatgcaacatgaaattgaaggtgcctaactgctcaaaaaacaaaatcagccatcatactgtaactctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctaaaaaaaaaaaa

SEQ ID NO: 382344 - DNA, 2458 bp, Homo sapiens
gacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggggagcgcacctcttatggtggacgcaagcgggggctctaaaggaccacaggcccccaaaagctgtccttagagaaactctcacagagacccggcaaataaaggagaaaagcgccgcataatacaaatcaaacctcggtcatggcgcgaggtagtgacacacccgagcgaccccgagagtatgaacgccgggtacacaaatgaggtgctcgacgatggaccagacagaacagagaaggtgtcgagaagagtgacgacaacgagcacgacgcagagagcgaaccacgagcaggccgagacagcgcaagacaacaacgacggacgaagcgagaggactacggccgagcacagcc

SEQ ID NO: 382345 - DNA, 3642 bp, Homo sapiens
gacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaaaaagtcacgctgggcccctctctacagggggacacacaggcttagtttagtatatgtctaaccagattttgcatgtcaagcatttgtccttttcctggcttatgttttcttgtagaaattatataaaccctatcaaatccactactaggtaaatttttaaaccatgcagctttattactctcctcccccaaagaatgtagtttgaaattttctcatttccatagtagagtctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctaaaaaaaaaaaa

SEQ ID NO: 382346 - DNA, 994 bp, Homo sapiens
tctcctgcctagtatgtatcactacaccttgcccagagagggtccatgcagctttattactctcctcccccaaagaatgtagtttgaaattttctcatttccatagtagaggccctaactgccattgtattactaataatgcaacatgaaattgaaggtgcctaactgctcaaaaaacaaaatcagccatcatactgtaactctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctaaaaaaaaaaaa

SEQ ID NO: 382347 - DNA, 2968 bp, Homo sapiens
gacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaaaaaggcccgggggggcccccctaaagggggggaccccggggcgcttgtggttatagtttcttcgtgttctacccaaggttctctgtgcgtgtgttcacggctattgggccccttaccgggggataggtgtctctggcggtagacaattttatttttgaccccgttattaaaagtccccacaatgatggcgcaactgttttcaagcccatgggacgcttttattaaaccctcttccccccaaagaagtggttgttgtggaacctttcctacatttccagaagaagagggcccaatgtgacgtgtatcactatagaggcccgcgaatgtggaggggcatacgtgccaaaa

SEQ ID NO: 382348 - DNA, 235 bp, Homo sapiens
atgcctccatttcatccaaccaagatcatgggagttttcagtcaccgaattgtccttggaattttcccaaaactaaaatttggcttatcatagttttagagaaaggggaacactcttccctcttcccatatgttacaaaatgtagatccctgatttgttgtgattgtgtgaatcgtaaggagtggcgccccagtggagatgtgcctgcagtgcatccatgggcttagaatactat

SEQ ID NO: 382349 - DNA, 870 bp, Homo sapiens
agcggagacactctgtgcaaagaacagaggcaagcctccagccaggagctcatgaaatcatgaactgaggcctcagtgcaatagctcatgaggaaatgaattatttcaacagccagttctggaagttggaagtacaagatcagattgccagcatcatcaggtactcatgagggccgtcttccagcttgcagactgccaacttctcattgtgtcctcaggtgaggaaaatttggctcgtggtgatagtcttggatatcaccttcatcccctcggatgtttgtagataatcctccattatatttggaatgaatactgtagatatatgaggttggactatcctacgttttgcttgtttatgggttttgcatcttgatgtcttcctgaagtattcttcatggggaatttccaaatcaaccacaatttgatatcaaagtaatgtcaagtgcttctgacccactgcattaaacgtgtgctgagcagttggtggtagaagacattattgtgaaggctgctcaccaccaatttcatcactgttgctaactccagctcatctaatctctgcaacatctgctaccagcaccttctcttgcctccttttgtgaacatagttttttcttctggttagaaaatcagttcgaacttcttgagttttgtgttttaaactcttctcaactgttccgatgattgatggatggcccagaggcgacctctttatctccagcaacatatttggctgttggcccggtagagaggtactccagaagcttgctggttcatcatgctctcatctttaaccacaactatttatctgactcctacctttcgctcagcataaggtgtttcatataactaataagacaaccacaccta

SEQ ID NO: 382350 - DNA, 689 bp, Homo sapiens
agcggagacactctgtgcaaagaacagaggcaagcctccagccaggagctcatgaaatcatgaactgaggcctcagtgcaatagctcatgaggaaatgaattatttcaacagccagggttgctctgaagactaaagccctgggatcattcattttaaaagaaaagaacggtgactcatcatttcaagcttttcattctggaagttggaagtacaagatcagattgccagcatcatcagatttgatatcaaagtaatgtcaagtgcttctgacccactgcattaaacgtgtgctgagcagttggtggtagaagacattattgtgaaggctgctcaccaccaatttcatcactgttgctaactccagctcatctaatctctgcaacatctgctaccagcaccttctcttgcctccttttgtgaacatagttttttcttctggttagaaaatcagttcgaacttcttgagttttgtgttttaaactcttctcaactgttccgatgattgatggatggcccagaggcgacctctttatctccagcaacatatttggctgttggcccggtagagaggtactccagaagcttgctggttcatcatgctctcatctttaaccacaactatttatctgactcctacctttcgctcagcataaggtgtttcatataactaataagacaaccacaccta

SEQ ID NO: 382351 - DNA, 195 bp, Homo sapiens
tataaagttgaaatatcaattttattttttaggaatctggtgaacagtaacaaactttggtgaaatttcaggaaccatagccattgaagtggatgagggaacctatatacatgcactcaacaatggtctttttaccctgggagctccacacaaagaaggtttgtgtctggaacggaagatcctgccacaagtgta

SEQ ID NO: 382352 - DNA, 1920 bp, Homo sapiens
  misc_feature (187)..(187): n is a, c, g, or t
agaaaaaagataatatactaattcttaattttagtaagtagacagttgtagtgtatggatgttttgttaaatctttgttgatacagaatatataatttcctttttctgtttgtgtgagaagtaaagattgaacaaaaatatgtgagtgctaaactgtctttaaaaagtagataactatatcaaaaanagtaaggaccagtgggcaccatgcagaacaagcaaatagaagctcagcctttgagtagcagctttggtagtatacaaaaatgaactgaaaataggaactcagcagtgttttaagatgacagattaaacaaacatcccaccagaaagaggtaatcacttagactaatttcctcatcccctaggataaaatcttaagtcagtgacttgaaaactattttgacccaatccattgagaaatgcatttttacattgcagcccagcacacacatatgtataactgaagcaagagttgtacttaacaatacttacttatccgtgtgttatgcatcttgatatttcttattctcttttaccccttcctctgtgtgtctgtgtgtattctttttcccccccacccacccgataccgttcaggaaacactacgttgatttcattacctgctaatgtgttgcaacccctttgagatgatcctactagttatgatgagatgcttctaataaaagttacaccagtagaaaatgccaatatttcataaggccaggatgatgacttagatagtactaatattactacactttaggaaagttcatttcattttatttttaggaaggacactaatagagttccataaaagaaaagtctttagtgcatgttatttattattcagggtgtagatactattttaacttccacattctaaattatagtgtgggtatcaatctatgaagtaggtgctgacaagttgtcaacattactgacttttatggtgaagttttaaatttgaatttttattcaaatataaatgaaaagaccattttctcaggtaaaaaaatctatcatgctttgatgcttttcactttaattgaaaaaagactcattataaaagtacaatgcaagaaatatttagaaaaatattcctgatctccagttgttactgtacctagatttttcttgggacctatgtgataaaacttatcatgattcttgaagaaatagaagttcatacaactgttatcagaatttatataaaatgtttctcagaaaatgtggtttctccagctcgaacattctataactctaagccaaattgaaagagcagattgatgggataaaacacaaagtatggaaataaataataaactgctaccctgaaaaagcctacctctgcacattgtttaaaaattggaaaaaatcctacttctgtgttctgatattcaatgcaagtcattagagtaaggtgagactcttcctgtggattcagattgaaatcagggacggtgtagggaggccatggtcaacttttgagctacccttgagggaagaaattaattgatcaaatattaactgcccaagtatattcacaggatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382353 - DNA, 496 bp, Homo sapiens
  misc_feature (443)..(443): n is a, c, g, or t
  misc_feature (480)..(480): n is a, c, g, or t
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgctgtcagggggagctctggcggcgacctgggatnacggcggtgaccgtgacccgccacagttgggccttgngatcctcagcttgctg

SEQ ID NO: 382354 - DNA, 974 bp, Homo sapiens
  misc_feature (187)..(187): n is a, c, g, or t
agaaaaaagataatatactaattcttaattttagtaagtagacagttgtagtgtatggatgttttgttaaatctttgttgatacagaatatataatttcctttttctgtttgtgtgagaagtaaagattgaacaaaaatatgtgagtgctaaactgtctttaaaaagtagataactatatcaaaaanagtaaggaccagtgggcaccatgcagaacaagcaaatagaagctcagcctttgagtagcagctttggtagtatacaaaaatgaactgaaaataggaactcagcagtgttttaagatgacagattaaacaaacatcccaccagaaagaggtaatcacttagactaatttcctcatcccctaggataaaatcttaagtcagtgacttgaaaactattttgacccaatccattgagaaatgcatttttacattgcagcccagcacacacatatgtataactgaagcaagagttgtacttaacaatacttacttatccgtgtgttatgcatcttgatatttcttattctcttttaccccttcctctgtgtgtctgtgtgtattctttttcccccccacccacccgataccgttcaggaaacactacgtccgagcacccaccggcaacggacgcagcagacaccaaagagaagatcgcactaaaaagagaagcaacgccgcctccgaccaagccacacaccccaaagaagacaacgatccacacgccacacacgcgacagacatcgcaccaatatcactgaacaccagcgaagccaagacaccccatacaaggacggcaacacacagtcgaaacacaccggccaacagacgccaacaacaagagggcgaaaacaataacacccaacccaccacagagcggacacaaaagaaacgaagcaggagcaacaacagacccaaggaggcaaaaacaacaaaacaacaccagcccgacacatgcagcataccaccccc

SEQ ID NO: 382355 - DNA, 1436 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtgaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382356 - DNA, 1562 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382357 - DNA, 1956 bp, Homo sapiens
  misc_feature (187)..(187): n is a, c, g, or t
agaaaaaagataatatactaattcttaattttagtaagtagacagttgtagtgtatggatgttttgttaaatctttgttgatacagaatatataatttcctttttctgtttgtgtgagaagtaaagattgaacaaaaatatgtgagtgctaaactgtctttaaaaagtagataactatatcaaaaanagtaaggaccagtgggcaccatgcagaacaagcaaatagaagctcagcctttgagtagcagctttggtagtatacaaaaatgaactgaaaataggaactcagcagtgttttaagatgacagattaaacaaacatcccaccagaaagaggtaatcacttagactaatttcctcatcccctaggataaaatcttaagtcagtgacttgaaaactattttgacccaatccattgagaaatgcatttttacattgcagcccagcacacacatatgtataactgaagcaagagttgtacttaacaatacttacttatccgtgtgttatgcatcttgatatttcttattctcttttaccccttcctctgtgtgtctgtgtgtattctttttccccccgatacacgtagttagcggttcagcgcaaacaagtacgattgtatcagcatgttaccctgcataagtgttgttgcaaacccgtttagagatgttcgccttaattagttatggtgagatgctttccgtattcaatcacagtctgacatcgcctagtataagcatgccggctgtttcatacgggccaggatgatgacttagatagtactaatattactacactttaggaaagttcatttcattttatttttaggaaggacactaatagagttccataaaagaaaagtctttagtgcatgttatttattattcagggtgtagatactattttaacttccacattctaaattatagtgtgggtatcaatctatgaagtaggtgctgacaagttgtcaacattactgacttttatggtgaagttttaaatttgaatttttattcaaatataaatgaaaagaccattttctcaggtaaaaaaatctatcatgctttgatgcttttcactttaattgaaaaaagactcattataaaagtacaatgcaagaaatatttagaaaaatattcctgatctccagttgttactgtacctagatttttcttgggacctatgtgataaaacttatcatgattcttgaagaaatagaagttcatacaactgttatcagaatttatataaaatgtttctcagaaaatgtggtttctccagctcgaacattctataactctaagccaaattgaaagagcagattgatgggataaaacacaaagtatggaaataaataataaactgctaccctgaaaaagcctacctctgcacattgtttaaaaattggaaaaaatcctacttctgtgttctgatattcaatgcaagtcattagagtaaggtgagactcttcctgtggattcagattgaaatcagggacggtgtagggaggccatggtcaacttttgagctacccttgagggaagaaattaattgatcaaatattaactgcccaagtatattcacaggatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382358 - DNA, 1463 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtgaatcgccctgaaacctggctatggaaaatatcttagtataaattcagatgaacttgttgttggcgttcagatgcaattggaccaagagaacaatgggaaccagtctttcaaaatgtgagtgctgttattgtttataaaaacttcctgtcagtttaacacaaagtctgtagcagtcaataataatatatttaaaaagaaaaagtaggatgcaatagtacaatacattaaattggaataaatcagtaagaacacagagccttaaagagatctcaaaatatagtgcaacaaaaatagctttagtacttttgcccacaattatttctgtatacccttagtgcccgatatggatctcatttccattgaagaaccagtcaattttaggtcacagagtaggaaaacagaatcgttcctaagtatcttctttgtggcagaaatcatggatgctttcagaaactttagagactgtaagcgaacagtagagctagctaataccaagttgtgacaatttgct

SEQ ID NO: 382359 - DNA, 1621 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaatatcttagtataaattcagatgaacttgttgttggcgttcagatgcaattggaccaagagaacaatgggaaccagtctttcaaaatggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaagcagaagcaatgtatgggagactgagtaattacatatgagctcacatcactatctcttccaccactgtcatccatcatgactgatctgggagatgaaacagcacagatctaaaggacgtggtaagaatcgagatcaccagagatcagtagatacttgcatacttggaggattaacactgtctggattccaacgatcagctgagtatgttcaagataaagctatagtacatattttagattg

SEQ ID NO: 382360 - DNA, 1293 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaatcgccctgaaacctggctatggaaaatatcttagtataaattcagatgaacttgttgttggcgttcagatgcaattggaccaagagaacaatgggaaccagtctttcaaaatgtgagtgctgttattgtttataaaaacttcctgtcagtttaacacaaagtctgtagcagtcaataataatatatttaaaaagaaaaagtaggatgcaatagtacaatacattaaattggaataaatcagtaagaacacagagccttaaagagatctcaaaatatagtgcaacaaaaatagctttagtacttttgcccacaattatttctgtatacccttagtgcccgatatggatctcatttccattgaagaaccagtcaattttaggtcacagagtaggaaaacagaatcgttcctaagtatcttctttgtggcagaaatcatggatgctttcagaaactttagagactgtaagcgaacagtagagctagctaataccaagttgtgacaatttgct

SEQ ID NO: 382361 - DNA, 1140 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtgaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382362 - DNA, 1310 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382363 - DNA, 1285 bp, Homo sapiens
taatttttttctaagctaatatgtagagtgaaaccaggatgaatcacacagtggttgaggtgtatatggactttgatagggatatgggctggaacctgcactctgtcatttactaattttgtaatttgtggcaaattggttaatatgtctgaacttccatttactcattaagagatcaagtatctttgaacctccgtttacacatttatactttcagaccattttttatacctttagaagactgtgacgattaaatgagagaacatacatgcagtaaataaattgagccaaatgtgaggaggaggttgtagtggtaatttattagctctttaggagaaaaatacctgtgcattcatatccccgcttcttttataactggcagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtgaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382364 - DNA, 958 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgagtaagaagaaaaagagcaaagataagaagagaaaaagagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtgaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382365 - DNA, 806 bp, Homo sapiens
ctcccaagtagctggtattacatgtgcacaccaccatgcccagctaactttttaaattttttgtaaagatggggtctcactatgttgtccaggctgatcttgaacttcttgcctcaagcacttctcccattggcttcccaaagcacagagattacaggagtgagtcaccactcagccacatgcatcttttgaacacttggaatatgtccagtctggaattttagatatgtacacacccacacacatacacatgtcctgttttgatgtcctataattaattttctcttagtttttaacttttatctatcttattaatgtacagaatcgccctgaaacctggctatggaaaatatcttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcaaaaaaagctta

SEQ ID NO: 382366 - DNA, 1155 bp, Homo sapiens
gaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagatgaagaaacccagcttgatatgttggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaatatcttagtataaattcagatgaacttgttgttggcgttcagatgcaattggaccaagagaacaatgggaaccagtctttcaaaatggtgcctgtgcagcagtattcactgtgataggaagtgagaagcagtctgagtgttcattgctgagggaatcaagggcaaaatatcatggatgcactcatggacaaataagcagcagtttgaagcaacaccctagatggatgtacagccatcaagaggatcttaaagtgtggtctttagtggaaaaaaagcagaagcaatgtatgggagactgagtaattacatatgagctcacatcactatctcttccaccactgtcatccatcatgactgatctgggagatgaaacagcacagatctaaaggacgtggtaagaatcgagatcaccagagatcagtagatacttgcatacttggaggattaacactgtctggattccaacgatcagctgagtatgttcaagataaagctatagtacatattttagattg

SEQ ID NO: 382367 - DNA, 761 bp, Homo sapiens
tgcgccccgaggtcacctatgagagaaggctgccgggttctcgatggcccattctgccaggtagagggcagcatctcatgtgaccaggcctgtgatgtcgtgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccaggtgtggctatgaaggggtggctgccttgtgatgattcaatatgctatgtttttcctttgtggttttctgtatctatgttttatcttattttcttttgagctctgtcacccaggctggagtcagtggcacaatcttggctcactgcaacctctgcctcctgggttcaagcaattctcctgcctcagctgcccaagtaggtgcaactacaggcatgtgccaccatgtgtggctaatttttccacttttttttgagacagagtttccctctcgttgcccaggcaggagtgcaatggcgtgatcttggctcactacaacctccacctc

SEQ ID NO: 382368 - DNA, 552 bp, Homo sapiens
  misc_feature (547)..(547): n is a, c, g, or t
tttggttcctgtgtgctgaaaacagaaggcagtgttttgagcagttgactttgcaggccagggtctctaggaaagttggggtgagtgaagctttgttcctgaccacagaggacacgatcttgagaacccctctctctacagcagaggaacccaccttcttggcttttcttcaccccttattttattgaggaaagattccctaaatgttacatgggtgaatatggtatagggctagttacacagttatataaacaaattctatttcttacatgcattgtgtaaaattttttttttttttgagacagactctcattctgtcgcccaggctggtgtgcaatagcacgatcttggctcactgcaacctctgcctcccaggttcaagagattctcctgcctcagcctcctgagtagttgggattacaggcatgcgtcaccacacccggcctcctgaattaacattttcctaaaagacgccggcgtgctatcctgaaagctgccagaggtgtcttggctgcattggtggtaataaaattcatactcataaaanacttt

SEQ ID NO: 382369 - DNA, 680 bp, Homo sapiens
ggtggaagggttgcctcaacccaggtttgaaaccagactgggcaacatagtgagacttccatctccacaaaaaattagccgggcatggtgacacatgcctgtagtcctagctacttgagaggctgaggaaggaggactgcttgagcctgggaggtcaaggctgcagtgagtcatgtttgtgccactgcactccagccagggcaactgagcaaggctctgcctcaaaaaaataataataattcccttttatagcaggtagtattccattgtatggatatactacaatttgtttgtgtactcactcattgataaatatttgggatgtttccagtttagggctattacaaataaaactccagtagtctcttggtatacctggaggattggttctatgactgcccaagggtaccaaaatttgcttgaagtccggcagtttgtctgtggaaactgcctatagaaaaagttgggttttgcatcctgcaaatactgtctttttgatctgcttggttgaaaaaaatgcacatataagtggatccgtgcagttcaaacctgagttgttcaacagtcagctgacactgtgaacatttgtgtacaagtatttgtatgaacataggctttcttttccctaggtaaatacctaggagtgaaatgactgaataaaatgaaagtgtatggtaact

SEQ ID NO: 382370 - DNA, 397 bp, Homo sapiens
ggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatg

SEQ ID NO: 382371 - DNA, 989 bp, Homo sapiens
  misc_feature (10)..(10): n is a, c, g, or t
agcgggtcanatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagt

SEQ ID NO: 382372 - DNA, 1055 bp, Homo sapiens
  misc_feature (10)..(10): n is a, c, g, or t
agcgggtcanatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgagctacctcttgtgtttaagaattaagggaagatgagctaggaatcaagaaatacgcagaactgattcctgtcactggcgccaccctgccacttgcccagagctgtggtataaatttttttaataggctgaaataaaaatatgaatagcattttggtgttaagcattaaattgataaaggctatgagatacacctgctctcaaccatgttaatttttattattggtattaataaattattacttactaacatattaacaagaattgcattgagaaacaaagcatccacaggccaaatcttctgaatttcaaatgtttatattaa

SEQ ID NO: 382373 - DNA, 1118 bp, Homo sapiens
  misc_feature (10)..(10): n is a, c, g, or t
agcgggtcanatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagtctgtttcatcttcataaaaacgctgctttcagtgcactggatttattttacaacccactaatggattaccctacagtttgaaaaacattgcgttagaccagtttgactgttgtcaagaaccaaaaaaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagt

SEQ ID NO: 382374 - DNA, 1306 bp, Homo sapiens
  misc_feature (10)..(10): n is a, c, g, or t
agcgggtcanatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgaagacagagtcttaccctgtcacccaggctggagtacaatggtgcgatctcggctcactgcaacctctgcctcctgggttcaagtgattcttttgcctcagcctcctgagtagctgggactacaggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggacaagtcctgcgcttggggatcctctgtacgcccgttcactgctaccatactgggaactgcccaatggagaggcccacattccacaaggaactgatgtcttcagccaatacctcgccaggacctgaggcctgctgagagtcacgagtggccttcgtgggtcctctctcaacgagcttgcaggtgaccactgcgccagccaaaaccttgatggcagcctatgagtgagtgaccctgagccagaagacccagttaagccatgcccaggatcctgacctgcagaaactatgacataataaatttattgttttatgccactaacttttggggttacttatgcagcaatagatagctaatacagctcatagtatccttatctagcctcaaacattctgcctttagtatctaactttcctaactttttagataaacttttttgggggggataat

SEQ ID NO: 382375 - DNA, 861 bp, Homo sapiens
agcggactggaatcagcaactccctggaactcgggcctctggccccgtccctcttttctccggcagggacgcaggatgccttggtgcactctagagacggggaccggagggtgcagcgcgcctgggtggggcgaagggcgccggtctcctcacgccctctgactttaggataccagacagtgtctcttcaaccccaccccaggcgcaggtttccagaaggcggggtgggtggggcccccgatttccagaaggcgagttacctagcaggtgtgtggggtgggcattgctattcggagaaaaatcaagacgttcccttcagtcctccctcggtgttaacgtctgctccagctcgcagcccgctgctgggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgagctacctcttgtgtttaagaattaagggaagatgagctaggaatcaagaaatacgcagaactgattcctgtcactggcgccaccctgccacttgcccagagctgtggtataaatttttttaataggctgaaataaaaatatgaatagcattttggtgttaagcattaaattgataaaggctatgagatacacctgctctcaaccatgttaatttttattattggtattaataaattattacttactaacatattaacaagaattgcattgagaaacaaagcatccacaggccaaatcttctgaatttcaaatgtttatattaa

SEQ ID NO: 382376 - DNA, 421 bp, Homo sapiens
ctggccctgggaagacccagctttgagcctcaggttgtgtctaatcatctctctgtccttgggccagtcaactcacctgttcgtgctgccacagagacagaggggccacatcagagagaaagactctacagcttgcccagagtcgagcttaaatggagcagcatgatttttgtctgaaaagtctgagatgggaccagtggaaaggtgtgcattttaagaaggatttgcttccccatcttgtgctttctgtgtcttgcagcacgacctggccctccacctaggaatcataccttcatcccccatactcataagcatcctcattcctgtttccttgtggatgtcatggtctgctgtgaagtctgcttggtgacccgtccagacctgacttggtataaatgattttgttgcagagaataacaaa

SEQ ID NO: 382377 - DNA, 420 bp, Homo sapiens
tttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagattttgcttcctggtggagtgggagcaaacaaaaaaatacataaataaaaagaaaacacttgcacgtcgtattgaaataattcatgggtctctctttccaaccagatttaaatttcaatgacaggtataggaatctactcctggattgtcttccta

SEQ ID NO: 382378 - DNA, 365 bp, Homo sapiens
atagtcaaattttaaatattttcttttatggttgttatttagtgttacttagaaaagccttccttactacatggttttaaaggaatttttctcccatgcttttatctgagaaattatgagcatcttttttgaaacctaaaacttttatccatttgcaataggtattctcccagttgtcttttttctctataagatttattgaataatcttatcttttcattactgattgaggtgccaccttgattttgtcctttgtgtacttgagactgtttctgaattcttctctaatcttttccagttgtctgtttattaaccagtaccatattatattattatgataggtagttattattatattattgagg

SEQ ID NO: 382379 - DNA, 282 bp, Homo sapiens
aagtgtgtgccactgtggccagctaaagactctggccatttaaggtaactattctcaggttctgagagaatagtgcacagacatcttcaggagtcaggattctgcctaccactgtaaccttttctgtcttcactgttttatccccattctcaaatgatgcctgccaccgcgcccagcctacttttatttttaaagacaggggtctttctatgttgagctcaggagttcgcgaccagcctggggcaacatagtaagacctcatttctatgttttttaattatt

SEQ ID NO: 382380 - DNA, 977 bp, Homo sapiens
aagtgtgtgccactgtggccagctaaagactctggccatttaaggtaactattctcaggttctgagagaatagtgcacagacatcttcaggagtcaggattctgcctaccactgtaaccttttctgtcttcactgttttatccccattctcaaatgatgcctgccacacactcaataaatactgatgggatgaaggaacctagataatagcaaagttgcatcagcttctctgtgctctctgtgccttacactcagtcggacttctctggggccaagtctggtagtagagggggatgtttaaaaggcaaaattctattaacagcttgttgggagaaaagatgactgttgggagagaagctgaggcagggcttgcatgtctgctagacttgctggttccttgcttctagcactcctgttatctcaagcagccatatgtttctcattcacttgatacactgtttcctttcaacccccacgtcctgaccacctgtttgtttgagcaccagtaaatagcgtgggctcccagagcttggggcctttgcagccttcacacttgtgatggccccctggtcccactttctctctcaaactgtgtttttctcaatcctttgattctgctggacttcttcacccccacgacctggtgttgggtctgatcaccccaacaacagcccatatgggggatggctggcagggatgcttcacccagaatcattttgacctggaatgctgggtctcatattttctacttgtcctggccatccaagcccatatcattggcaggcagatgtagatcatagaaaaatccttggaaacttgggggtcccagtaatgaatgggaatctgagacagaccaatcacactcttacaaaccaattcaaggtactctgaattcaactaaaccatggcactgtgactgctcagacaactgaacatgtgtattcagtatattccccaacaaaaccctgtaaaacatc

SEQ ID NO: 382381 - DNA, 874 bp, Homo sapiens
attatttttaatttattcaagggttttattataggaagcagacaagaaaaaatagaacttacttcacttgtttagtaaatgaatagcaaagcaagagtaagcatcagagtaaagtttatctttgggtgcctcctggtcaacttcctaactaaccaaaatgtctttctctcaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382382 - DNA, 3373 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382383 - DNA, 1621 bp, Homo sapiens
aatcatggactggctgtgcttcaggcactttggcggctcactataatttattattcatagagttatctttctgagactgtcagttttaagctattttaaaacagcattacctttactttagcaatacttcatttcttcttgtattccctagcttataaagaatttaatttcatttttaaaataagttattccgtaggatgatgttgaaatacatctgcattagcaacaccggcatactgcacaatagagtttaatttatatcatgatgactacatatttgaatcagactcgagaaacatagctaatgaccataaatctaatggaatatgtatcaatgtgttttcttccttaggtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtatagtttgtgagttactgggggcgaagacatttacagacatgttcatgatcacttcatttgggcttacattggccagttcaacatatccttccttcatgatgaagaaaggactatttctaaatcattcttgcaggtgctttgtctgggatggaaattccgttttatctggcagtcagtctggtgaactgctcgtttgggacctccttggagcaaaaatcagtgagagaatacagggccacacaggtaagcagctactgcagttgccttgatctttgttctcaagataatgaactcaagcctgccttttccatcagggaacatactctttttgggcaaaaaacacccatggtttttccatgtcgtaaacatgtccctggagcctcttgattggccaggtgatctgcatctcgtaggttactcaggatttagatttatgttaacagccattggactccaaaaaggaagtctttaactttcatatggagaattaaaaaccatcgtaaagctattatttttcttaaaggtaatagcatgatcttaaatttttagaatagt

SEQ ID NO: 382384 - DNA, 697 bp, Homo sapiens
  misc_feature (23)..(23): n is a, c, g, or t
  misc_feature (113)..(113): n is a, c, g, or t
cccattttgttggtgtggacccntcgtcgatcggctcgtacccagtcgacgagactctctgaggttcccttttgttagtgggacactcagagagatggttagaactatgtggnaatgacaaacagaagttaatacaggtaaagtgtagaacagccccaagtgcataggaaatgctgctattgctatttccttagctgaaaataggtgaatttttttttcatatgtagtattgcagaaacttggaaaaactgtctggatggtgcaacggattttaaagaggtaagcagttaataaagctgatgagtaactggacttggggtttctaactgctttaaaacatgtttgttgttcttttttatttttccccgaaactttcagttaattccagaattctatggtgatgatgtgagctttctagtcaatagcctgaagttggatttgggaaagagacaaggaggacagatggttgacgatgtggagcttcccccttgggcttccagtgagtccccccttggaggtgttgtattatagacatgctttaccaagtagtgcaatttcagtaattattttattgcttagatttttaaaaatcacaatataattctctaaataaggatatatgagccctattccatatcagaagtattctatgagtctgtgatgtaaaaacattaatatatatttgagagaccttaat

SEQ ID NO: 382385 - DNA, 1791 bp, Homo sapiens
ccacgcgtcgccacgcgtcgcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382386 - DNA, 3966 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtatagtttgtgagttactgggggcgaagacatttacagacatgttcatgatcacttcatttgggcttacattggccagttcaacatatccttccttcatgatgaagaaaggactatttctaaatcattcttgcaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382387 - DNA, 1875 bp, Homo sapiens
aatcatggactggctgtgcttcaggcactttggcggctcactataatttattattcatagagttatctttctgagactgtcagttttaagctattttaaaacagcattacctttactttagcaatacttcatttcttcttgtattccctagcttataaagaatttaatttcatttttaaaataagttattccgtaggatgatgttgaaatacatctgcattagcaacaccggcatactgcacaatagagtttaatttatatcatgatgactacatatttgaatcagactcgagaaacatagctaatgaccataaatctaatggaatatgtatcaatgtgttttcttccttaggtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382388 - DNA, 3576 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtatagtttgtgagttactgggggcgaagacatttacagacatgttcatgatcacttcatttgggcttacattggccagttcaacatatccttccttcatgatgaagaaaggactatttctaaatcattcttgcaggtgctttgtctgggatggaaattccgttttatctggcagtcagtctggtgaactgctcgtttgggacctccttggagcaaaaatcagtgagagaatacagggccacacaggtaagcagctactgcagttgccttgatctttgttctcaagataatgaactcaagcctgccttttccatcagggaacatactctttttgggcaaaaaacacccatggtttttccatgtcgtaaacatgtccctggagcctcttgattggccaggtgatctgcatctcgtaggttactcaggatttagatttatgttaacagccattggactccaaaaaggaagtctttaactttcatatggagaattaaaaaccatcgtaaagctattatttttcttaaaggtaatagcatgatcttaaatttttagaatagt

SEQ ID NO: 382389 - DNA, 2856 bp, Homo sapiens
  misc_feature (2840)..(2840): n is a, c, g, or t
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaatgaccagggtgcagtatatcccggaggggagacggacagtatatctgcaatggggataaggccttctctcgtaattatgacctattagattttagcaactttacggcggtatgtaggtgattgagtacacggatggttggttcactgggcgagccagattcggaagggggccggagcagtgatgaagtcaatattctncccgcagcgcacacac

SEQ ID NO: 382390 - DNA, 2025 bp, Homo sapiens
taagaaatatggacctcttgcctgtcctagaagctttatatacatatagatagacaagagaaatgggaggaaaaaaatgaagactccatgatttttcgattgagtctaatctaataggtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382391 - DNA, 3830 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382392 - DNA, 3318 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcattttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaaaaaaaaaaa

SEQ ID NO: 382393 - DNA, 3522 bp, Homo sapiens
gaattcgcctcgatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacaggaacagatggctgtcttaatgtcattgatgtgcagacaggaatgctcatctcctccatgacatcagatgagccccagaggtatagtttgtgagttactgggggcgaagacatttacagacatgttcatgatcacttcatttgggcttacattggccagttcaacatatccttccttcatgatgaagaaaggactatttctaaatcattcttgcaggtgctttgtctgggatggaaattccgttttatctggcagtcagtctggtgaactgctcgtttgggacctccttggagcatgatctttgttctcaagataatgaactcaagcctgccttttccatcagggaacatactctttttgggcaaaaaacacccatggtttttccatgtcgtaaacatgtccctggagcctcttgattggccaggtgatctgcatctcgtaggttactcaggatttagatttatgttaacagccattggactccaaaaaggaagtctttaactttcatatggagaattaaaaaccatcgtaaagctattatttttcttaaaggtaatagcatgatcttaaatttttagaatagt

SEQ ID NO: 382394 - DNA, 324 bp, Homo sapiens
atccaatatttattcactttatgaaaacagatttatttgtactgtcaggcttattataggccttgattgcatttccaaaagggcctgtcatttggcagctacagtttaatgcttttattcacaatttgtagaagacatgtaataactactcatcacattttgggatgtcataaagatgggaaagacaacagatgtaaaagataatggagtaagattcaaaaatactttgatgtgttggaacaaatggccttaaacccacaaagatgaagtttaatgggaaaaaatataagagcatgagagtcacctgtgggccttgttggccat

SEQ ID NO: 382395 - DNA, 250 bp, Homo sapiens
caaatagatggaacaaaactaaaattttagaaacttatgtacccatatataaacactggatgatagagtttgggtatttgttccccccaaacctcatattgaactgtaatcctcaattttggaggtagagcccagtgggaggtgatcggatcatgggagcatatttccaatgaatggtttagcaccatctccttggtgccatcctgacgacaatgagttcttacaagatctggttgtttaagtgcacggc

SEQ ID NO: 382396 - DNA, 445 bp, Homo sapiens
tgtataaattttctaaaacacatcgcactgcatattttaaaacatatgaattgtatatcatgtaaattatacctcaataaagctgtttaacttgaaaaaaaatgaggcagctttataagttctgataagggagcaatctccaacctgtatagttaagtaaaaaggccaaggtactttaattctacagagtgctatcatttttgtaaaaaaaaaaaagtgtatttttcatatgtatagaatatctccagaaagatacaatagactggctaatagaatttgcctttggacaggggagtaggatggctggaagacagggatgtaaggaaacatttaactgtatttcctttttgtaccagggtggggtggggtggttgagacccaggtcagccataccagctcttttatagtgggcaaatgtctgagcctttgttttctcatctgtaaa

SEQ ID NO: 382397 - DNA, 366 bp, Homo sapiens
tcgtgtcactgcactgcagcctgggtaacagagaaagaccctatctcaaaaaaaaaaaaccaaacaaaaacaaagctagaaaaccccactgacttctccaaagcctccaggaagacacgttcctcctcctcccagggctgaggtctccccactgcacagccacactcccaggtagacagaagaggcctccctgagtcacaacctcctcctccagggctccagcgattctctcagctcagcctcctgagtagctgggaccaccatgcaccaccatgcctgtctaacttttttttgtactttttgtgaagatggggtttgtccatattgcccagtctggtcttgagctcctgacctcaagtgatccac

SEQ ID NO: 382398 - DNA, 367 bp, Homo sapiens
ttgagttcttcattcacataagccacgtgttaaggacttgatagctgcatgtggctactgggttagtcagggcagccatagaacgtttttaccatcgcagaatgggcagcaccgttctacttcttaccacctgaatagtccacaagcacctcaaactcattgtgctgcaaacatatcatcagcagaatgttggtgtatgtggaaaagtgtggcaaagagaaataagggaaggaggaaaaggatcctttcagttattaagttctataacatttgtctcaaacagacttcaataataaagggggtttggctggtcatggtggttcacacctgtaattccagcactttgggaggctgaggtcggcggatc

SEQ ID NO: 382399 - DNA, 732 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggtaagagtatggtctgcagagaacaggtgggtaaaagttggagaggggatttaggaggaaagaggacatagagatgcaaatcattaattattacctgcagtattactttggtggttctgatgagctcagaataaagtcaggagaaagaaatcaacagcagaggcattcctaggaaattggggttccattctgactaaattttcctttgattggaatatactggaatgtaagcttcatgggggcaggcacttacgtctcttgttcatgctttatccccagtgcctataacagtgtctgacacgtagtggggctcagtaaaaatttgttgaattgagtgactgaattgagtgaatgaaagttgaattgaata

SEQ ID NO: 382400 - DNA, 279 bp, Homo sapiens
caggaatttcccaggaccctgaaggggccatgatggcaacaaatttggaacctcagcctggccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382401 - DNA, 2430 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382402 - DNA, 2209 bp, Homo sapiens
gtgggcttgagcgtcagtagtggcactcgggatggtggcatcgctttacatcctagggagggactctcttaccacccgggattaaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382403 - DNA, 2151 bp, Homo sapiens
agagggcctggggttgggcgaaatttcgggcgaccgaaggggcgggcgggatgatcgactggatggagggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382404 - DNA, 2154 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaaatgtttccttccaatgggcttttggtgtaggatgtcggagaaccaagaacaggaggtaagagtatggtctgcagagaacaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382405 - DNA, 2414 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaaaaaaaaaaaaaaaaaactcgggtgggggcccgtacccaattcga

SEQ ID NO: 382406 - DNA, 2124 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgccagcctatgctgtgggactgtcatggcatttagttcagagtggaggggctttggcctgaaataaaatgcaagtatttaa

SEQ ID NO: 382407 - DNA, 1602 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccagcagcaggagtcacagcaccagttccattcagtggtatcgtcgacgcgaccgcgaatttagtagtag

SEQ ID NO: 382408 - DNA, 2370 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382409 - DNA, 2316 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttgggacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382410 - DNA, 2112 bp, Homo sapiens
cattcgccgtccctcacccggcacctgcgtgcactctccggcgtcccaaatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaa

SEQ ID NO: 382411 - DNA, 3226 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaagattgttgttgcaatttgtgtctaacaagctgtagcagagaaggagggagtgagcgctggcagtatttcctttcataaatcatgaatttatcagtgtggaaataatgcttcagaactgtgctctgtagccctcctgcattgtgtgtgcagctcaagttcaccactggaggaaggattgtcttccaaagagctgggatccaactcttctcacagttctgggcgtgaaccttgttaggtatactttacctgatgctgcttccatcctcgcagtctgtctgaggtgccaggtgctgaaagagaaataaagtttgtcaacaggcagatgcaaagccctggctggtattcatccctctttcctgcccgcctcccctgggtctctcctttatatgatgcagcagagcaaggcgaggatagaaaacctacagaggcaaatccaaaatgtcagaagaagttcatttaaaaggggaaaaaaactccatgtgcaaccctcacaaaaacccgacagatgctaagctaatggcatccgctctgccgattggtggggatggctcatgaatattaatgagcccaatgctccaaatggtgcagctgtgaacccagctgtgcctgaagctctctgatctcgaaacttccagacaggagctggaggtggtctgtgtcaattccctactcagccaaaaaaacagcaagctgggttggccttcttctgtttgctccttttcttcctggagttggtgctcagcagctagttctgccagccggctaggctgctgggacagcaggagccattcaaagacatggatgtgatttttctgactcccagcttttttaatgatccattagcagcatgcataca

SEQ ID NO: 382412 - DNA, 2255 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctcggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtccggggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagcctgtctgtgggctcttttactaccagcctatgctgtgggactgtcatggcatttagttcagagtggaggggctttggcctgaaataaaatgcaagtatttaa

SEQ ID NO: 382413 - DNA, 800 bp, Homo sapiens
  misc_feature (3)..(3): n is a, c, g, or t
  misc_feature (9)..(9): n is a, c, g, or t
  misc_feature (13)..(14): n is a, c, g, or t
  misc_feature (35)..(35): n is a, c, g, or t
  misc_feature (37)..(38): n is a, c, g, or t
tgnctattnttanntttggaatcctttgcactttngnnccctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggtaagagtatggtctgcagagaacaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgtgagtttgctcttgcttccttcttgggtctgtgactggctttttgggtgcttatgtaggaactggagttgacaatgaagagaacttgcaacataccaggcactaaggaaattgggaaatatgttgtttctttttttgttttttgggtttttttttttttttga

SEQ ID NO: 382414 - DNA, 233 bp, Homo sapiens
aataattttttaaaaatactcaagtactttgatgtttgaactgcagagaatttttgaaaaattgcctacttatttttttttgttttagccaaaaggccaagaagtgataattgcctatttattttcaaaagttgattaatgatacgttgccattttataccattaaattgttgtcccatttattttgatattttaataagaattgcttgttccacatgagaatttcatacctc

SEQ ID NO: 382415 - DNA, 559 bp, Homo sapiens
tttgggcactatttcaaattattaggcttctggaaagagtgcttccagggacagcaagttactactgcacttgaccattcctagtcctcacctgattaccagaaggtacgcaaggtaaaagttagctgataggccctgaattgagaaaaaggaatcaccaagcaatatccgtaacattacacattttgccagcacattttctatgctatcagctaaaacgtaattttggtcacaaaatagggctgtagtgtagtttctacttcttattccagttgtttgattatgaggatacatttcttgctgctgtcctccactaaacagcagacaaattgccaggtgtgctggctcatgcctgtaatcccagtgctttgggaggccaaggcaggagtttgagaccagcctaggcaacatcgtgagaccccatctctacaaaaaaaaaaaaagaaaaaaaaaattagttgggcatggcaatgccgcctgtggtcctagctactggggaggctgaggcaggattgcttgaacccagaagtttgaggttacagtgagctatgatcatgtc

SEQ ID NO: 382416 - DNA, 256 bp, Homo sapiens
catagacctaatgccaggttacagaaaattcactggagagagaaataacaccacaagaaatcaatcagtcagaagagaatgcagggtcttctacaagacaactgacccagtctcttcaaaaaagttaatgtcatttttctaaaaaggttggaagattcttctattcttctagattaaaaaaagttggagatgtataactcaatgcaatatatgaaccttgcttggatcctagtttggaaaaaaaaaaaagctataa

SEQ ID NO: 382417 - DNA, 1532 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382418 - DNA, 1286 bp, Homo sapiens
gggcggcgcgtgcgcgccccggatccggcggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382419 - DNA, 390 bp, Homo sapiens
tccctcctttgcaccctgtaaagggtcagggtgaatcagatgggggactgagcaagtagctatgactgcagatcatgtaaggaagggcctgacaagaagctcccagatgctggggagaatcttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382420 - DNA, 1521 bp, Homo sapiens
cgcgccacctgagatgcccaggctggcctctgccaggggcttagtctgccctctcctggggcttcagaggccaaaagcaccctggtgaggggtccgggaggcccgggagggcccggggggctctgccaggcccctccacgcctctctgcccagccagcacgctctgggaagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382421 - DNA, 1413 bp, Homo sapiens
gccagcggaggagagagtgggcgccaccgtggggctgtcccaccggtggaggctccagcggagatgagctgggcaggcctcgcggagcaagtgcaaactgcacccgcgtcctgggggcatctgcggggagacttaggggtcatgctttgtgccccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382422 - DNA, 1048 bp, Homo sapiens
gggcggcgcgtgcgcgccccggatccggcgccgtagggtgtgtgctgtccgggctcacggggaccctgtctccgagtcgttcgtgcagcgtgtgtaccagcccttcctcaccacctgcgacgggcaccgggcctgcagcacctaccgcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382423 - DNA, 907 bp, Homo sapiens
cattcggcacgagaacgccgctgagacctcagccttgacctccctcagcgtggccgggaccctgagcctctgcgcagagccacccgccccgacgtacttaggcggcatagcctgagacctctggccagcgccaggcaggcagcgggggcggcagaggcctgggctgagtcttctggctctgcctctccctggggacaggagggagcctgggggtgtgggtggggagccggccggccgtgacccagcgcctggctctgcccgcaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382424 - DNA, 1124 bp, Homo sapiens
gggcggcgcgtgcgcgccccggatccggcggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382425 - DNA, 1708 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaaaaacaaacaaaacaaaaaacacaaaaaccacacaaaaaaaaaaaaaacgaagagaaataaaaagaggacgaaaacaccaaacaagagagcagggccacaccgaaccacacacaagagaacgaacaaggagaaacggcgcgcccaaagagaagaaacagagaacgggcaacagcaa

SEQ ID NO: 382426 - DNA, 1091 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccctttccaaggacacagcatttccgagacccgcacatcagactac

SEQ ID NO: 382427 - DNA, 803 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcaggtgagggctatgtccctcggcgcccggtgttaggagggcgactgttccccaatcttccagcaacgctcctgctgcttttcttgaaccccgagcaaagcaccaccttgccgcagagcacccactccctagcagctgcccccacagggtgctggggacccaactgagctggtga

SEQ ID NO: 382428 - DNA, 224 bp, Homo sapiens
ggcggggaggctgtggggagcagtgatctctgaccttcgcctcatccaaccctaggctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctcccctt

SEQ ID NO: 382429 - DNA, 260 bp, Homo sapiens
gagcctccctgcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcaggtatggcaggggtggcctcggaggggcagggagcggacagggcgggccccccattcccctcactcccg

SEQ ID NO: 382430 - DNA, 264 bp, Homo sapiens
gacgtacttaggcggcatagcctgagacctctggccagcgccaggcaggcagcgggggcggcagaggcctgggctgagtcttctggctctgcctctccctggggacaggagggagcctgggggtgtgggtggggagccggccggccgtgacccagcgcctggctctgcccgcaggagtggacagtgcaatgaaggaagaagtgcagaggctgcagtccagggtggacctgctggaggaggtgaggcattggtgggggggggggg

SEQ ID NO: 382431 - DNA, 1607 bp, Homo sapiens
cattcggcacgagaacgccgctgagacctcagccttgacctccctcagcgtggccgggaccctgagcctctgcgcagagccacccgccccgacgtacttaggcggcatagcctgagacctctggccagcgccaggcaggcagcgggggcggcagaggcctgggctgagtcttctggctctgcctctccctggggacaggagggagcctgggggtgtgggtggggagccggccggccgtgacccagcgcctggctctgcccgcaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaatgataaaaacaaaaataaaatcaaagacaccagaaaaaataaaataacagaaatagatacatcgaggcgcgtagtatggagaaagaattcactcaccggggaggacgcgcgaagatggacaagcgcgcgctagaccacacgattggggaagagcagacgaaagtccggccaccccaataattagagagaggggccccttcctgaatgatgcaccccgcaatacgccgccgaagcagaccggacgctggatgcagacacgccatgttggagaaacggcaagagccatgagaacgggccgaaccacgcggagggcgatcccacttctgacgagaagggaaggaacagcaaccaattttgctctatgggcggcggtacggttgtgcgcaaacaaggaataatgtctggagggcgaaggacatggttaccgaccagtatagatagacattcgattttaagcattaagttcgctggtgtagaggggagaagacaatattatgatacacacattgtgtgaaagaactgggtgggggaaattagaacgtagtgggtttagtatgaaaccatacaaaaaggagtgtgccaaatataaatcgtgttcagtgcgtgaggtagcgaaaaagaggaaggttcgcgcccatgtagagggacaggggatatcgtaatcattttgtgggacaaaggcctatgtatttacttgta

SEQ ID NO: 382432 - DNA, 2232 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaatgataaaaacaaaaataaaatcaaagacaccagaaaaaataaaataacagaaatagatacatcgaggcgcgtagtatggagaaagaattcactcaccggggaggacgcgcgaagatggacaagcgcgcgctagaccacacgattggggaagagcagacgaaagtccggccaccccaataattagagagaggggccccttcctgaatgatgcaccccgcaatacgccgccgaagcagaccggacgctggatgcagacacgccatgttggagaaacggcaagagccatgagaacgggccgaaccacgcggagggcgatcccacttctgacgagaagggaaggaacagcaaccaattttgctctatgggcggcggtacggttgtgcgcaaacaaggaataatgtctggagggcgaaggacatggttaccgaccagtatagatagacattcgattttaagcattaagttcgctggtgtagaggggagaagacaatattatgatacacacattgtgtgaaagaactgggtgggggaaattagaacgtagtgggtttagtatgaaaccatacaaaaaggagtgtgccaaatataaatcgtgttcagtgcgtgaggtagcgaaaaagaggaaggttcgcgcccatgtagagggacaggggatatcgtaatcattttgtgggacaaaggcctatgtatttacttgta

SEQ ID NO: 382433 - DNA, 1434 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 382434 - DNA, 2050 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtgaaaaaacaaaaaaaaaaaaaaaaaaaaaaatatacaacaaaaaaaaaacacaaacaaaaaaaaaaacaaaaaagggggcgcccctactaaatatactctccagaggagggcgcaaataatacacgtctacccacgtttttttgataacaagggggccccaataatggagccgtctatacaaaaccagcagactgcatcgcgcccgtgttttacacacctgtatacattgagaaaaaatggtatatgtgggaaaatctttttgtggaaaggagacccccccataaatcacgagaggggagcaacaacaaacattatggggaacacacacaataccctcatagacaagatattaggacgacccccatgacggcagagtaccactctatacactctttatcaagcgatcgctttaaacaggtgtttacacacacaacactcaagatatatatcttcggtgataatcagaaaattttggcccacagagaggatttatcacataggagaaaaaatttattacgg

SEQ ID NO: 382435 - DNA, 1067 bp, Homo sapiens
gcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggaggagctccctgctggagcctgggacccatggcacaggccaggcagcccggaggctgggtggggcctcagtgggggctgctgcctgacccccagcacaataaaaatgaaacgtga

SEQ ID NO: 382436 - DNA, 356 bp, Homo sapiens
ctcgccgtaggccgggcacaccctctcctctgggcctggatgcccccacagtaggagaccagataggtgggggcacacacaggcctggccactgcctctgctccatgcggagtgtggctgggccttcctgctgtggcttgagtcccggccagcaccggaaggcccaggcagggaaacggctgtgcagtgacccctcagtgccatcccttgaggagaagacccttgggggcatgctggggtgaccctgtgcactctgagaggggactctagatgcccagcaggtgactaagggggagtaggatgcccctctgagctgtcccacccaccccacagaaccatctataggaccgcctacc

SEQ ID NO: 382437 - DNA, 378 bp, Homo sapiens
tcaccttccctggcctgtttcctcaaacttaaatgccatagttggcgcagccagatgatcccaaagtgagcaatctgagaagcaacaggaactccaggactctctgaccttggtgcttggtttccagtagggaacgatacatttacctaaggaagaacctgcttaagggaaatctacctggactgctaaagtcctcagtactgctcaccgtagcttcctcccttcttctcaagtgaatcaccattattcttattttgtcagcaagcgctttccctcactttactgatgggtcctgatctataattgttctgtgttcacccataattcctttccttttgtcttttacatacttaccaaattttggcccatccagaattt

SEQ ID NO: 382438 - DNA, 495 bp, Homo sapiens
cctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttggagatttga

SEQ ID NO: 382439 - DNA, 440 bp, Homo sapiens
gtttttgtttatgtgaaaatatttacatatgtatcatttctgtatatatcacagaaaagttttcacttgcttgacattttattctacaatgatttttagtttaagtttaaagaatggctacattcagatttattttcacaactatagtcctgctaaactgccttcattgaaaactcagtttttatgataaaaaatatcaaagcacaagtttgttattggaggtaaattatacatttcttagatatctattggtactagacctttgtaattaaaattaatttattttacaatagtaactgacctgtatggaaaaaaaaacaaccttgaattatgggttctaatatttaaatatcgaaaaatatggttatttgtgcatattcttattacaaccaagaaaagaactcctgataagaaaataaataaatatttaacatttctaa

SEQ ID NO: 382440 - DNA, 577 bp, Homo sapiens
taaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctag

SEQ ID NO: 382441 - DNA, 360 bp, Homo sapiens
cttctcaaattgctattacatctgtgctcctggcaaaatttttacttgtcatctccaaagtataccttgtattttcctgtacatattgttagtattttctttccaaacaggagtatcttcctttcattctcatttctactttggttatccttcaattttacttcagttgttgctttcttcacaaagtcttccccactcacccagaaggcagtgaaccccacctctatgagcttatccagcagagcttttaatgttcatattactcaccaagatatgtcattctttcaacaagcacgcacagatggcctcatgtgcatgtggcacatgcaatagccacaccctgcgcttcagggtattacc

SEQ ID NO: 382442 - DNA, 378 bp, Homo sapiens
aacaatggcggtcctgcagataggagatgggtgctttccataaagccactggaaactatgaaagctcagcaaacatttgaaggaggtagtattatcttctcaacatgacactcatttctttccgagtgcttatactttgtcctcactgcccccaaatcaacttttttccttttttcatccaactaatgtttatttagcacatgccacatagagaaaagatatatatacttcatattctcagtacagggaataaaaataaaattcagtttgccttgaattatcaattgcatcaaattgtttggctgtcttccggaccagagggaggaaaaatggtgaaaacattgcttcaagaacatagtggccaggcgcagtggctca

SEQ ID NO: 382443 - DNA, 1239 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382444 - DNA, 235 bp, Homo sapiens
gcggccgcctactactactactgctcgaattcaagcttctaacgatgtacggggacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382445 - DNA, 281 bp, Homo sapiens
gagctgctggaaagatctttattctcattttctcttcagctactgctgagaagccaggagaacggctcaagaccagattagtgtcatatcatctcaactcatttcagtcaggatggacgattatgtcctaaattctgccagctagtttaggctaagacccagcattaacctggtgcggtgagaggctggagagtgctatagagaggagagaggagtgtactgcccaggtctttgacagatgtaattctcattcaattaaagtttcagtgttttggttaagt

SEQ ID NO: 382446 - DNA, 1669 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttct

SEQ ID NO: 382447 - DNA, 1386 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtaaaaaaaaaaaaaaaaaaaaaaaaacggggggttttatggggggggggaaaaaaggtagaaagggctgggatgggtttcgggcccctttttggaaagggggaaaaggcggggccccaaaaggggggtaaaataaagcgggtacgtaa

SEQ ID NO: 382448 - DNA, 1881 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtaaaaaaaaaaaaaaaaaaaaaaaaaagaaaaaaacaaaaaaaaataacaacaaaaaaaaaacagagaggagcgggcgggggcgcgcgagccacacaaattatcccccgcgggggcgacgccaaatgtacgagcgcgacaccccacggcgtttctttctgtgagacagaagggggccccccctaaaggggggggccgctagtctataacaacggcgacgagagcgaggcgaggcgcgcggggtctataaacaacagcgcgcgacacgcggggacaaacaacagcgcggcgcagtcgccgggcgagcacactttcgagggggagaagcgagcaaaccccacctacctgcgcgggggggggggggcgagacacacacatggtggggagcaaaccaacatcgaccgctaccagagaggataatattaaaggcgcgtgacagggggaggaaaaatattatatagctaactttctaagagagcgtgtgaatatagtggggtgggtgtgaacacaacaaaacggggggactaaataatttgcgagggggagcggagagaaaaaaaaattattggtggaacaacgagggattatatatgtttgttgtggcaaataaatttcttcttcaagcgggggcggtgtatgtaaaa

SEQ ID NO: 382449 - DNA, 1224 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatatcgtgggtacagcgctcgattcgta

SEQ ID NO: 382450 - DNA, 1064 bp, Homo sapiens
  misc_feature (21)..(21): n is a, c, g, or t
  misc_feature (23)..(23): n is a, c, g, or t
ccggtaccagagactgagcanantgaagatcatggggaagatcttagaccaaggcgccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382451 - DNA, 1100 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382452 - DNA, 945 bp, Homo sapiens
cgccaggccctcttgaagcagggcaagatatcctctccgctccgcatggcggcagcggcctgcacaccaagggcgcccttcccctggatacggtcactttctacaagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382453 - DNA, 873 bp, Homo sapiens
  misc_feature (21)..(21): n is a, c, g, or t
  misc_feature (23)..(23): n is a, c, g, or t
ccggtaccagagactgagcanantgaagatcatggggaagatcttagaccatggggaggacttcccagcatcagagatacacggatcgccgttcgatagagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382454 - DNA, 1163 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccaccaatgtccatgctgacgaagccgggaccgggaccctgccctggccatgcctgggatagctactcgacatctgggagcctatgactcatagagctaagcagagcgccatgtccacaccacgcaagcaactgagcgccagcagg

SEQ ID NO: 382455 - DNA, 1053 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtggggtgaaatgacacctcagaaggaatgagtgctatagagaggagagaggagtgtactgcccaggtctttgacagatgtaattctcattcaattaaagtttcagtgttttggttaagt

SEQ ID NO: 382456 - DNA, 1175 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382457 - DNA, 1558 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttct

SEQ ID NO: 382458 - DNA, 604 bp, Homo sapiens
aaaaaagaaagaaaaggacggaagagtacataagagaacgaggcagaataacataccaacacatcatgcagaccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtgctcccggagggttaaggctcccggagggttaaggctcccggagtattaaggcgtcccggagggctaaggcactt

SEQ ID NO: 382459 - DNA, 379 bp, Homo sapiens
  misc_feature (3)..(3): n is a, c, g, or t
tgnaaaaaagcagctgtaccgtcggaatcccggatcgcccggcgatatggctgccgctgtgccccgcgccgcatttctctccccgctgcttccccttctcctgggcttcctgctcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382460 - DNA, 692 bp, Homo sapiens
cagacacaaaagggcacatattgtacatttccatcagaatagacaaatctatagagacagaaaatagatgagtggttgctggggctgggaggaggaagactggggagtgactgcgtaatgagtatagggtttccttttgggatgatgaaaatgttctggcactagatagtaacctctatggttgcacattcttaatgcactgaatcatgcagaatgtacacttttaaatggttacaatggcaaatattatgtgaattttactgcaattaaaagtcttggccctgacagtttaaaacccagagatctagccagagggaagtgtagtctagggagaagacattgtcccaagcctggcctctcactagcttatctgccctgaaattgctgggttcaaactctggcctatctagccaaagcgtcctccatgatgccaactcctttgtaggtaggtttgtttatttttgtcagatttcttgttcagggtttactgcgaaaggcctcctgggatgatgagcatgacaggggctgatgtagtatgcagagggtctccttcacctaactgaaaggaaccctgaaggagaaggccttagtatgtctgcagccttgtttattctggacagggttgtgtatatctttgattagtgtgaacaggtactaatggggtgccctgcatgttgctggcactcactaaa

SEQ ID NO: 382461 - DNA, 1167 bp, Homo sapiens
  misc_feature (3)..(3): n is a, c, g, or t
tgnaaaaaagcagctgtaccgtcggaatcccggatcgcccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382462 - DNA, 1201 bp, Homo sapiens
aaaaaagaaagaaaaggacggaagagtacataagagaacgaggcagaataacataccaacacatcatgcagaccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382463 - DNA, 1711 bp, Homo sapiens
cagtaagttaaatgtagacttagcatatgaccaccacagttccacttgtatatatacccaaaagagtggaatacaggtgttcaaacaaaatgtgttatgtgaatgttcatagcagcactattgacagtagccaaaaggtggaaacaacccaaacattcagctgatgagtgaataaacaaaaatgtggtctatcgtacagtgtaatatttatttggccataaaaagtaacagtgtgccaatacatggtacaacatggacaaaccttgaaaacatgctaagtgaaaaaagccagacacaaaagggcacatattgtacatttccatcagaatagacaaatctatagagacagaaaatagatgagtggttgctggggctgggaggaggaagactggggagtgactgcgtaatgagtatagggtttccttttgggatgatgaaaatgttctggcactagatagtaacctctatggttgcacattcttaatgcactgaatcatgcagaatgtacacttttaaatggttacaatggcaaatattatgtgaattttactgcaattaaaagtcttggccctgacagtttaaaacccagagatctagccagagggaagtgtagtctagggagaagacattgtcccaagcctggcctctcactagcttatctgccctgaaattgctgggttcaaactctggcctatctagccaaagcgtcctccatgatgccaactcctttgtaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382464 - DNA, 1240 bp, Homo sapiens
  misc_feature (3)..(3): n is a, c, g, or t
tgnaaaaaagcagctgtaccgtcggaatcccggatcgcccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggggccccttgggaaggggaattagccccaaaagtccctggaacacccacttgctcagctctatacgccctcaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382465 - DNA, 1364 bp, Homo sapiens
  misc_feature (1045)..(1045): n is a, c, g, or t
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatggctnagcgctctgagcaatacctttcaaccatataaaagaataaattcatgtatggtgaagcaacagggctggaacggggagctattatcctaagtagaatacttgagaaacagaaaatcaaataccacatcttctcacttacaaggggaagctaaataataggtatacttggccataaagaggggatggagacaccttacagacttcaagtggtgtgagggtgagatgggtgaggactgaaaaattacccatggggtcaacatacacaaattcattactatacaatatattcctgtcaaaaactgccttcaaacgcccaaat

SEQ ID NO: 382466 - DNA, 845 bp, Homo sapiens
agcttatctagaggatcccagcgctgcgcaatacctactcgagttacttgtcatcatcgccgtttcgatagagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382467 - DNA, 722 bp, Homo sapiens
cgagggaactatcggctaggtcgaggctggtgttgaatcggccgaggctactacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagt

SEQ ID NO: 382468 - DNA, 920 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaatccgcctgtctgagggatcctctatgcca

SEQ ID NO: 382469 - DNA, 767 bp, Homo sapiens
  misc_feature (748)..(748): n is a, c, g, or t
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaattacgctcgatgttacttgtcatcgcnctttcgatagggggtaccg

SEQ ID NO: 382470 - DNA, 4004 bp, Homo sapiens
  misc_feature (322)..(322): n is a, c, g, or t
  misc_feature (1167)..(1167): n is a, c, g, or t
aaatgttaaggaggcttatttaaatattcagggcttcaactaaagatctaaccactaagatcaaaagagttatttaaataaaagttgttgagacattttttcatctgtattaataatgtggcttttgaagttacccggtaataatgtgtccataatgcccacacctaatttttaatttccattttggctttaggtgtggctttattttaatagctgccaaaaagttggcaattgtttttacgtttagaacttcacagtttgcttttctgtaggtttaggtagcattggggatattcgtctaataaaaacttttaaaatttcngttctgaccctgaggcacttaaaaaaaactcttatgggccaaattttaaaagtagagtgtctctactactgcataaagaatttctataaaagatgaaacatggagctgattgaaagaatagacggcgcaatggtagaggacacatagttaccactgtcactggtaatctacagcttgatgcgaagtcattccgccttgtttgttgaaatgttaatcatttcattaagaaaggttaagtaattaactgatatttcattagggaatcaatgacagacctttttttagtgatgtatggtagatattttctaatagaaagtttgccccatttaattatttggaaagaagctagttgattgagccttgggaaggaggggtggggcatcttcagataacatctatgtccataagcaactttaaataattttggagaaaatggtctattagaatagaaaatcgttcagtccccagttttcttttatgggctccatcaggcatgttgttgcagacctgctgttgttttgcatgccttctctgggtttaagaagggttcagctgcttaaatgtgttcatcttattttctaaataatggcttttgttgcagtgtgatgcatgttgacagtaaacgcgcagccgtaactttggcacaaaaaaggaacaaagagtaaatcagtgagcacccatgtacctgtagcccggcttaagagagaagacgctgctggttcaggtaggagaggctcctggaatatcccatcctcatcttacctctgtccttctttcctagaggttactttaccactgttcgcagctgggtggttttcatcttgtgtagttcttcatatttttantatgtatgcatgtacaggattcctcaaaatacaggattttgttttgcacgttcaaggtttgttctgatagcatcctactatatatgttttttagtaacttgcttttttaaaaaataaacaacagtaaaattcatccatgtggatacatgtagctatagcttattgatttttccatgtgaaccttttgaaatactggatattaattcaagacaagttctttaaatttgagcctaaaacccagtagcactctgtacattgaaaatttcagattcataagaaaccatcagtcctgactggaacttcataatttgttcatttgtctgtgttttgggggaaaaaactttaaaacctcaaccatttatcagggaatttgattaaaaaaaataatctatcaagtggctgatctcttacattaagggaaaaaacaggcaaagcattcatttgaaggagcctagccattttctctttcttatttaaagacttggcttggaacttagcagttacatatgcagggtagcgagttaaaaagccatgtttaattaacaggcgctttatacttctgtatccttgttatgatatagcaccttgttcttcagtgtagaaagtgatttctgcatattttaaaggactggcatctttatggtaagaaagccatataaataaagatatacttagatgaaaatcggaacatgtttttaaaatagtgtgtgtctactttcatctctgttatcaaacttgctgcataagccagagttgatgctctgtgattatgctaatgaccaaaagaatcgatgatgcgagactagatgaaatcagtggtataatcggggaaagttatcagtttttttgtcattaagtattagtgataaataatacactgttcatttcgagtggatagaacatatttaattctgatgtacagagtttcattttagtcaggctcattgctgagtaaaatgatcatcttttgtaatttaagaggaaagagaaaaggcatttttgtcagcctggctaactgacttgggccatctagaaatgtttaccttgaccagccagggaagattggaaaaacttaattttttttcctcctagacaacttgcttatttgtactgacattttattaagaatatcagatactcagtaaatagcataaatgactagagatgttaaacaaaatgagtataaaggtagatagtgtttccctgaagaatggggaaaatgataacaaaggggcaatgtttggataatgctctttttaaatgactagtctgcattaaccaggggctattaaagtcggtatcacccattagacagcagttttaattttttttaattgagtttttcatatcaaataagatcatacttagtaatggtttacttaaagagaagtaatacttgtaacttagaatcttttcctgggttactaaaaccttaagggaaaacactgattctaccttccttgtcaacaaagcgtttctaacacaattctctgtaacagacatttctctgtggatagagtttagcacttgttttactactgtatgacagtacctggtgacaagagagaaaataaaagaataattagcaatgttctgtaggacatgaaaagtgattgaagtctacgagagaaggaaatcagatcgatgttattttaaaaaaatgcatcacaaaaatgattctcttcaaagcaaagcctcctacccaggctggggccagctgtgctctgccatttccctgccacagccctgtccgtccacgttggctcttaccagcagtaccatctgctgctccagcagtggccttctctatggtaaggcaggccaattgggtcaaatcttgtgatatggcagatgtccactgagagctaagattgggccaggctcatttttatgtgtgtccaaagccaagatttcaacttggtgaaaggctgtggaatttatttccccaagtgttgcccaaactctgttcttttcttcaactgcctccttgggctgagatgattgcttaatgctcttaattatgctggatccctctgtattttcgaacacctgtgggtaattcagatcatgagtggtcacagaggctggctcgacaaacggcttccctttccgaatgggaaaatcccagggagctggaccatgcaccgtgtgtcagggagctgagtggaggctgaaagaggatggaacacttcccttgaacttgaactggcattgtgttgtgtccaagtatccttcacccttggattggggagagtcttacaatgaataactcagaaaaaagttttcaaaataatcctagattgtaagatatctacgaccattatccatagccatatctttaaaaaaaaaaaaagaaaagtagaaaacaagaaacaaggtgtttctttacccaggccaagtgagcactaaagcttcctgtcataatgaggaggcagtgggggccactttgcttttgagacttggagtcccagtattactgggagtgccctgacccctcaggtagggacttgtcagagctccagaagacctaaggtacagtcagagctgagccacgcctttgtccatgaagagaatggggttgaaagtggagactgaggccgaggcgggtggatcacgaggtcaggagatccagaccatcctatcctggctaatacagtgaaaccctgtctttaaaaaattagccgggcgtggtggctggcgcctgtagtcccagctactcgggaggctgaggcaggagaatggcctgaacccaggaggcagagcttgcagtgagctgagatcgcgccactggactccagcctgggcgacagagcgagactccgtctcaaaaaaaaaaa

SEQ ID NO: 382471 - DNA, 402 bp, Homo sapiens
ttggtggaatctctgcctgggatatagtctttgagtatattctgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtttgtgggccttgactacagttgaatctgtagttgttctttagatgggatattcgttattgcaaaggacacagccatgttgcaggagagtcctcgagtatgggatttccgaaaggagacagtgttgtgtatgtgcttttctcttctggttggtccccctttctgcactctccctgcccgcctttcttccagtc

SEQ ID NO: 382472 - DNA, 370 bp, Homo sapiens
gatctaagtaatcaatcaaatggtgaacagcccacaaccaaatctgaaaatagaagtgaggggatataattggcttataattattggtgaggtagagcaaaggtttaagtaaagtgagtccaatgcatttcttcagtgaacgttgtggactaccatgagccagaaactgggcattatgtcttccaagaaatgtaagacagcttttttttttttttaaactttgaaaggttgtattatacatttgttcagataatctgtttccacgaattgtcagattcacaaaacagaacttgtaggaagtagaactcagagaagtaaaatgaggtatcttcatctctatttttattttttcccctctgtcccctttttc

SEQ ID NO: 382473 - DNA, 546 bp, Homo sapiens
atatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgct

SEQ ID NO: 382474 - DNA, 389 bp, Homo sapiens
cagaaatgggatccaggtagtctattgagcacagtttttttgtctttcctcttatcctacattccatgaaataatataaaatgtagctttaaaaagatgattcataattactgagagaaaattagaaaaattcccataagtagattaaaaaatttgaaaaacggaaaacgagtagaattggaaggatggagaaaaatacagcttgaaacacacagagcagaagatacagaaagtacatctattgtttgattcattcattttatgcaatataataaaggctttttaaaaaaaatacacacacacacccatatatataaacaattatcccctgaataatatgggcgttagaggcactgatccccatgcagtcgaaaatccacatgtacctt

SEQ ID NO: 382475 - DNA, 421 bp, Homo sapiens
tttaaatatgagtattttctgtcttctaagatgaccttttgttttctcacaaaaattttagtattctccaggtccagaattaatgttattataaaaaccactgtttttattttgttttcattgtctgggtattttattgctactagaatctgtatttttcatccctaaattaagccaaatatgggtagtgaataaattttaaaagacaagaactctgttagcagagtcaaatgcatgaaaatcattgcaatatcttgaattttaatattaaaagcccctgaaggagtagctctaacatatcacaggacaaaaatatagagaagatattattttcacacagccctaaaataaataagttgcctgatacccaggactttttaacattcatgttaagggtgatacctcaaccacttccaggaaa

SEQ ID NO: 382476 - DNA, 733 bp, Homo sapiens
aaggtatctccatcgttaagcaatgcatgactatatattcccgacaggcagatcagtaataatatcgtgctaaccccaatttgtgatttttagtgagtaattttaccttaagaaatttgaaactctcctgacaaacatacaatgttttctgttgccaaaaatattagaagcataaattgaaataataaccatttttatttttcttttttgaggttggcaaaaactgctaaaaatctatatgcttgaatagtctgtaatttagaagctacttacatctttatggctcctcccgctttttatgaaaaattagacaaaaaaagatactaacatagctttcaccagattgttaatgttttaccaaatttgctttcgtgtgtgtgtatgtgtgtgtgttcatattgtagagttggcaaaactccattctagtcttcttagggtcctggctgggtctgagaattaaatcaatgtaacatagatgaacatttattacataacataagatgatgacataacatagatgaatatttattacaagttttacatggaacagaagccattttttaaaaaacaaagaccaaagccaggcatggtggtgcacgcctatttcccagctactttggaggctgaggccaaaggatctcgaacccaggagttgcaggttactgtgagccatgattgcgccactgcactccagcctgggtaacagagcaaggccctgtctcttaaaaaaaaa

SEQ ID NO: 382477 - DNA, 350 bp, Homo sapiens
  misc_feature (347)..(347): n is a, c, g, or t
tcccatcaacagtacatgtgaatttcaatttttccacaacctcattagaacttggtattgtcagtgtggtagatactgccagttgtcccaggatctactttccccttcttcctttaataacagatttaatgagtttcacctggattgcagctgggcatgcccaaccaaatcatagacaagatgatgtggctgaaagtaatatgcatcacttctgggtcatgaccttaggaagcatgctccttagaaggtatgcttcccaaactcgagggggggcccgggtacccaatttcgccctattagttgagtcgttatttacaatttcactgggccgtcgtttttacaacgtncgt

SEQ ID NO: 382478 - DNA, 611 bp, Homo sapiens
gaagtgccgactgtatatagttctccagatgttaataagtgctatgaggaaaaataaagcaggggagtggatttagggacatgccagcagagtggtgggatggtggggttgtgattttaaataagatggttagggaaggcctcacagggagggtgacatttgaacagagccttgaaggacatgaggaagcaggccagatggatcacctgggggcacagcattgcacgcagaagaaacagcaagtgcgaagaccctgagtgggacagtccctagtttgtgctggtaacagcaaggagtccagtatggctggagctgagggagagggagagtagtaggtaagatcaaagagaaagggcaggggagattgtatagggcctcatgcagtttttaggcttttaactctgagatgggaaagtattggaaggttttgagcagagtaatgacaagatctgatgtgccttctaaaatgactgttgtggctgccatgttgggtagactatatcagggcaggggtagaggcaagagaccagttagggagctctttcagtatttgaggtgagaggctggatgctgtggctcacgcctataatcctagcactttggaaggccga

SEQ ID NO: 382479 - DNA, 263 bp, Homo sapiens
tctgtgctaagtacatttcttttataaatgaaaacataatcccctgttaaatgctttacctcatgaaaccttctcctggaaaaaacaaaacaagggaggctgaggcaggcagatcacctgaggtcaggagttcaagacaggcctggccaacatggcaaaaccccatctctactaaaaatacaaaagttagcagggtgtggtggcgggcacctgtaatcccagctacttgggaggctgagacaggagaatcgcttgaacccggg

SEQ ID NO: 382480 - DNA, 676 bp, Homo sapiens
gcaattccaaaatagattgcacgttcccagagttcagatggatccaggggaagaagtatttgtggtaagagctacagaaactccaccaaagaggtaaaagataaggaaaagcataccagacaacaattaattgatacagagaaactcctgagatgaaatgtgcgtatttgctgagcatttttaaggcattcccaggccttttaggtcattctggactgtttctctgcttttctgagctatttcaatgacagtagtagcttcctttgtatcctatttttgcaaaaggtgtatctgcctgctatggtttgaatgtttttggcccctccaaaattcacattgaaacagaattcctaatgtaacagtattaagaggtgtggcctttaggaagtgattgattcagaaccttcatgaaaaggaccagatgcccttataaaataacttgacagagagagttagccgtttttgcccttccatcccttctgccacgtgaggacatagtgttcttcccctccggagggtgcagcaacaaggtgccatcttggaagcagaaagcagccttcgccagacacgaatcctgcccacaccttgattttggactttctagcttccagagcagtgagaaataaatttttgttctttataaattataaatacagatttataaatctttataaat

SEQ ID NO: 382481 - DNA, 303 bp, Homo sapiens
tgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcatt

SEQ ID NO: 382482 - DNA, 530 bp, Homo sapiens
aaggacaggtgggggagttatttgtttgtttatttgtttgttttgatttcagaaagatgtgaactccaggatctcttgagagactgccaggtaagcaaccctgtggttaaaattcagtctttggtcccacactcatgataaatgcaatcatagcttcatacatctggcatcaagaaacagtaatctttcagcaaaaactctcacttggtgtatttttctcagccttgtcacaagaccttccaatttaacctgaagacactcctgaattagtaggaagctcaacaatatttcttccctgacaaatccttgtacttcagctccagctatctctgggaatgcaaggtgactccttgttgggaaaatactgcatttgtcccttccacggtaatgggctgttgctcaccatatatagtgagatttttccaagaaagagaaatatgtcccctttgctccataacctaagaagaaaataaaaaccatattcgcccaaatagaagaaggttgaattttgcttgttattgtcagctttg

SEQ ID NO: 382483 - DNA, 272 bp, Homo sapiens
aaggacaggtgggggagttatttgtttgtttatttgtttgttttgatttcagaaagatgtgaactccaggatctcttgagagactgccagagccagcagccccaaggatacttcgaacagtgggcactggtgcaattctataaaaagaaaccagaaaccatttagatgtgtgtcaggaagaagcacttccagatgcttgaggaaagatgcaagatagcaaggtgggaatctgagaaacaaggagtttaaggattttgccataagtcacctag

SEQ ID NO: 382484 - DNA, 3254 bp, Homo sapiens
  misc_feature (23)..(23): n is a, c, g, or t
  misc_feature (25)..(25): n is a, c, g, or t
  misc_feature (32)..(32): n is a, c, g, or t
  misc_feature (938)..(938): n is a, c, g, or t
  misc_feature (1045)..(1045): n is a, c, g, or t
tgcattcaggccaaggcggggcngncggatcnatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattccnccagtgcatactgtaggtcattttttttgcttctggctacctgtttgaaggggagagagggaaaatcaagtggtattttccagcactttgtatgattttggatgagntgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382485 - DNA, 3123 bp, Homo sapiens
  misc_feature (23)..(23): n is a, c, g, or t
  misc_feature (25)..(25): n is a, c, g, or t
  misc_feature (32)..(32): n is a, c, g, or t
  misc_feature (807)..(807): n is a, c, g, or t
  misc_feature (914)..(914): n is a, c, g, or t
tgcattcaggccaaggcggggcngncggatcnatgctcagggttccggagccgcggcccggggaggcgaaagcggagggggccgcgccgccgaccccgtccaagccgctcacgtccttcctcatccaggacatcctgcgggacggcgccgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattccnccagtgcatactgtaggtcattttttttgcttctggctacctgtttgaaggggagagagggaaaatcaagtggtattttccagcactttgtatgattttggatgagntgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382486 - DNA, 1788 bp, Homo sapiens
tcgaactctagaggattcccccactactggccaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382487 - DNA, 1342 bp, Homo sapiens
tattactaaattcgcggcgctcgacttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382488 - DNA, 398 bp, Homo sapiens
ctccgtaccccctttggggtctttgctattgtgttgcaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382489 - DNA, 3046 bp, Homo sapiens
  misc_feature (23)..(23): n is a, c, g, or t
  misc_feature (25)..(25): n is a, c, g, or t
  misc_feature (32)..(32): n is a, c, g, or t
  misc_feature (730)..(730): n is a, c, g, or t
  misc_feature (837)..(837): n is a, c, g, or t
tgcattcaggccaaggcggggcngncggatcnatgctcagggttccggagccgcggcccggggaggcgaaacgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattccnccagtgcatactgtaggtcattttttttgcttctggctacctgtttgaaggggagagagggaaaatcaagtggtattttccagcactttgtatgattttggatgagntgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattaga

SEQ ID NO: 382490 - DNA, 1013 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgaaaaaaacaaagggaaaaaacttcggggatttatgccggggggcgaaaacacggggttatggaaatggggcatgtggttaaggtgttccttagacccggttttcttgcacaaggtggaaaattgagcgggtccacctatgaggagtggataactgggatagccggttacgctgta

SEQ ID NO: 382491 - DNA, 2804 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctcacggggagacagagacatcaactgacgattacaatacagtgtccccagcacggtgcctggcacaggcaggtgcttaaccaaagtttaactgaaaatggcaaatgctgtggaatatgccaaggtctcctggggggtgacttgagggctgccccttcactgcccacccctctaccaactcccacacatgtagactggtcgcttggcctcacctgccctctctccccagggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382492 - DNA, 2856 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctcacggggagacagagacatcaactgacgattacaatacagtgtccccagcacggtgcctggcacaggcaggtgcttaaccaaagtttaactgaaaatggcaaatgctgtggaatatgccaaggtctcctggggggtgacttgagggctgccccttcactgcccacccctctaccaactcccacacatgtagactggtcgcttggcctcacctgccctctctccccagggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgaaaaaaaaacaaataccgtagctatctaacaatgtacaacacaacaaagaggg

SEQ ID NO: 382493 - DNA, 2245 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgaaaaaaaaacaaataccgtagctatctaacaatgtacaacacaacaaagaggg

SEQ ID NO: 382494 - DNA, 1998 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382495 - DNA, 2025 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaaaaaaaaaagtcgacgcggccgcgaat

SEQ ID NO: 382496 - DNA, 1444 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccatacccctctgcccagggtaaggctccctaagatccggtagagtcacc

SEQ ID NO: 382497 - DNA, 1456 bp, Homo sapiens
ccacgcgtcgcccacgcggtcgaccacgcgtccgatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382498 - DNA, 2373 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcgagacggagtttcgccaggctggtctcgaactcctgacctcaagtgattcacccaccttggcctcccaaagtgctgggattacagggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382499 - DNA, 1998 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatga

SEQ ID NO: 382500 - DNA, 2193 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382501 - DNA, 2289 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382502 - DNA, 2082 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgagacggagtttcgccaggctggtctcgaactcctgacctcaagtgattcacccaccttggcctcccaaagtgctgggattacaggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatga

SEQ ID NO: 382503 - DNA, 2341 bp, Homo sapiens
cctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgaaaaaaaaacaaataccgtagctatctaacaatgtacaacacaacaaagaggg

SEQ ID NO: 382504 - DNA, 1763 bp, Homo sapiens
caggtgcatctgaagctgtctgggtgtggcggggggcatatacctccccatcccaattggccatacccagcctgatgtttttactgaattccattcctcagtctacacgtttcaagttaacacgttttttgcgcacctactgtataccaagcactaatgattaagacttgcttcctgatatgaaggatctgggtaacccagtacttgatgaggaaggggtagctcagagggaggagtcggctcagggaacacccattctaggtgatggggccacaggtgcgagccccaggctgaagggggagagaggctccaggcctgcgtgcagatcaggaaggagaattggccttccttcaggatggggtggcagtaagccaacaatagcagctctggggggggggggggcgctccaggggcctgctgcatcctctggccctctgcctccccacagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 382505 - DNA, 2152 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcgcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382506 - DNA, 2778 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382507 - DNA, 2711 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382508 - DNA, 2998 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcaggaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaaaaaaaaaaaaaaacatctcaaaaaaaaaaaggggcagggcgacataaaaaataacaccaaaaggggcaccaagatagaagcgagaaacccagattacacagcggcacaaaggtgggcacaatatagcgagaccgccggatattgaaaaggcgaagcggatagtcggccgcgcagcggtttacaaacgagctgtcgtcactggggcacacaccggggcagccgtggagacaccttgtgtggaagggagccatttatcagtgtgatgtgtggagacatatatgtggcgccaacatgtccctt

SEQ ID NO: 382509 - DNA, 1812 bp, Homo sapiens
atggcctttgtacttgttatcatctgcataaacgctcctactgtgcagacggtgggactatcaagccagatgaccaaagatgggtgatggaaaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382510 - DNA, 1232 bp, Homo sapiens
ctcctctggcctcttctgccccacagcctgctggtttcccaggctcctgggccgtgaccactgcctcacatacagataggtttcccttcaccttctctttgcatctccctctcttcactacaatgccaggaaagtcacctctgaaagtcaccttgtccctccctcatcttgccccaagcactccacaccccactgcctgctggggcctccaatgtgacattcccaacaggaacagcctcggggctgccccagcaggtcacatgtatgtcaccccaccccctcctcacccaggtggaaggccttgagagtctcagcctattccccccgctataccagctctcccacctggagctgagtgtccttgacccctcaggcggccactcatccctctgccctgccctgcctcttacttctgcaccactgcaggggggcccagcctgcactcttacccattgcagtcctgctaatgtggacaaaaaccacatgcagcccacgctacacaatgcctcccactacctggaaggccgcactgctcagaatggaggtcagggcccaaagctgtctaactcactccccacacctccatccacatgtctgcagtactccttgttctttgctttccttggttcatctctggattcgtctctgtcggaagtgctcttcctcccctctggatgtccaaatctgccaccgcccctgcaggacaggtcccctctctcctctgagctcccccagcatgtctcaggtgttctgatctctgacacacaagtctgtcacctccaggcactttaagctcctgggggtggcaggggcagggggaagcccctgatatggcaggggattgggaaatgcttgtggagtgagggaagcagggagaaggattgctggcctccaggatcgctgaggctgtccccacggcatgacgtgttttcatgactgtggccccgtttccctggtgcctgcttcctggggacacactcaagggttaagctacagtgcttgccatctgtttacaggaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382511 - DNA, 484 bp, Homo sapiens
ctcacaggacagggctccaagtgggtggcccagaaccctgcagagaaaaagcctgtcctcctcagggcctctgtgtccaccagagcatctctgcatagtctcccaatttggggggccacgcccctctccggggtgggaggggaggcggtcaaagcaggcaaacctcagagctgctctgttgccctcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382512 - DNA, 2653 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382513 - DNA, 2251 bp, Homo sapiens
gctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaa

SEQ ID NO: 382514 - DNA, 701 bp, Homo sapiens
gtgtcttggtacagctcgtggctgtggtcagtgtggtggagggtaggtcttctcagatggtaacatgcatgagagtcacctggggatcacattaacatgcagattctgattccctggatctgggtgggacctgaggttctgcatgtctaacaaactcccagagaacacccatgtagcaagagtacagacaaaaggattcaaagcgaagggactgcaagaaccatggaaccagcctcccacgattttgcggatgacgaacccgagccttggggagtttcagaggccatggagagatgaagtataataaacagcatagcagttgtatgttgagccaagaatcagacatgcacagaactgctgattggaaaattaaatctgatctcatagccctggtgtgggcaaaatgcctagctggagtgggtgaccgctgatttacagtggggcttcttggtagggaaaattagtccatcccatttacagctacttccaatgcagctgtgtcaggggagagagaagaaaggacatggaagagagtgtagaggtatgatcttcagtcctttcaggcaggcacataagtaaatttttatttaaaagataagaattggtcatatgcgaatctcctgttagataagattaaaaacaaatttccattttgtggagaagttgcagataaatatttttccatgggatccaaaagaatc

SEQ ID NO: 382515 - DNA, 507 bp, Homo sapiens
cagaaagtgaggatgagagtgagaactcccactaaaaagtgaaaattctcaaagggggggaatatggtacgagaccaccacttctcctgttgtccttcccagtttctccccaacctccccttttccctagtttataagacaggagaaaagggagaaagcaaaaagttggaaagaaacagaagaaagataaatagctagacgaccttggcgccaccacctggccctggtggttaaaatgataataatattaacccctgaccaaaactactggtgttatctgtaaattccagacattgtgtgagaaagcactgtaaaactttttgtactgttagctgatgtaggtagcccacagtcacattcctcacacttacttgatctattatgactctttcacgtagaccccttagagttgtaagcccttcaaagggctaggaatttctttttcggggagctcggctcttaagatgcgagtctgctgatgctcccggccgaataaaaaacctcttc

SEQ ID NO: 382516 - DNA, 400 bp, Homo sapiens
tctccctcacagccccagaaggaaccacccttgatctcagtcttccaaccaccagaatcatgagaatttctactgcgtaagcccccaagtttgtagtactttgttacagcagccacaggaaatgaatccacacacatccacacccacccacatgcacacccggacacgacaagcgtgcggcccccagcgctgactccctgggccttcaatctctcattccatgcgtgtcttgtccgtcgttccgctttccactaatatttgcagcagtccgcataaagtcttggtggcttcgctctgcatgatctcagcatgaactctggcaggcagacaaagagtctgcagtaagttaatagtgctggtaaacatcattgtagtggggtgaatgttcctttcagtttgt

SEQ ID NO: 382517 - DNA, 414 bp, Homo sapiens
tgtaaggtaacattttgggaggaggccattattgtgcctaccacccgcattagctcctcaactttcccttcccagaggagaaccagggacagaaaacaataattctgccattcctcgagtacttactgagcatgtattatgtgccaggtattgtttcaatcagctggaacagagcggtaaataaaacagacacaaattcttcaccacatgatgcttatatcttggtgttgggaaggaaagaatatacataatacataagcaaaacctttagcaagtaagatgataaagaatcctgggttgtctttggtggctcacacctgtgatcccagcactttgggaggccaaggtgggagaattgcttgagaccaggagtttgagaccagactgggcaacatagtgagatcccttctctaa

SEQ ID NO: 382518 - DNA, 294 bp, Homo sapiens
gagcctagctctgcatttaggagaacagcacagcgcaccatgatctgatataggtataggtgggtgggagtctcagtctgtagttctatatcacctattaagagactggaacctggtcccatgttttctgcaggaggttgagctcttaacaatgtgccaagccagcagctgtgccctagagtcttggcctaagacaagcaaataattgtcagatgactgaatagttctgtttccttattaaatcttaggtttagaattcctttcacaattaaaaagatttggacaacaacttta

SEQ ID NO: 382519 - DNA, 3001 bp, Homo sapiens
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 382520 - DNA, 3563 bp, Homo sapiens
  misc_feature (3016)..(3016): n is a, c, g, or t
  misc_feature (3018)..(3018): n is a, c, g, or t
  misc_feature (3028)..(3028): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgaaaaaaaaaaaaaananaaaaaaaaanaaaaaaaaaaaaaaaaaaaaaaaaaaaaaaggggggggggcaaaaatttctcctccagagggcgccccacagtctctgcggcgcactccccactgtttttgtgtagaaaaggagggtgcccactactcgtggggcctgactattatactcctcagagcgacagggtgcgagctcatatcacaacaggcggcgcagacgcaggcgaagcacaacggcgactcgctccgcagccaacccctttgggcgctacacaacgcacccacccctcatcaccttccggcgggggcgcagcgagaccacacacctcctgggcccccccaccctcacccccgctaccccgcccgcgataccatttcagacacccgccgtaccgatgcggcaccacactctacccacgctccttctcgaccgggcggctatatcaacccgtggctctccccacacccaccacagccccgcctactgacctgtcacaccccccgcgccccaccaacgacacatcttcgcccgcccccccctgccagcatccctcccc

SEQ ID NO: 382521 - DNA, 3473 bp, Homo sapiens
  misc_feature (3050)..(3051): n is a, c, g, or t
  misc_feature (3059)..(3059): n is a, c, g, or t
  misc_feature (3066)..(3066): n is a, c, g, or t
  misc_feature (3070)..(3070): n is a, c, g, or t
  misc_feature (3072)..(3072): n is a, c, g, or t
  misc_feature (3074)..(3074): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgaaaaaaaaaaaaaaaaaaaaaaaaaaaaaaaaaaaaaaaaaaaaaaaannaaaaaaanaaaaaanaaanananaaaaaggggcgggcgcgcgcgcgcgcgcgcgcccagaagaaaatcgtcaaaacaaacccgcggggggggcgcgcggcggccccccagagaaaggaggagagaaagcaggggaacaagagggggaacacaagaaaagcgcgggagaaaaaacaaaagcgggggggaaatccaccacacaaaagaaaacgcgccggggggaaaacaccagagagtcatgcagaaaaccacgcgaaagggaaacgagagacacaaagcggaggcgccatacacaaagggagagacacaccaagggaagaggcgaaaaaacaaataagcgcacacgggcgctgggtggacgacagcaagcggaaagcaacagagacaacagaacaacagagaacacgcgcaaaccgaacaagc

SEQ ID NO: 382522 - DNA, 1867 bp, Homo sapiens
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatagagatgagatccagtacatctttggggagccctttgccaccccactccgggctaccggccccaagacaggacagtctctaaggccatgaccgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccatctcccccgacaggcaactccgagtctgcccccgtccctgcaacgggtgactctcaggatgcccctgtgcccctcacaagtgactctgaggctcccccgtaccctacgggtgactctgaggcccgtgcccaccttgggtgacactgaggctgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccc

SEQ ID NO: 382523 - DNA, 604 bp, Homo sapiens
ggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccatctcccccgacaggcaactccgagtctgcccccgtccctgcaacgggtgactctcaggatgcccctgtgcccctcacaagtgactctgaggctgcccccgtgcccccctcaggtgactctgaggctcccccgtaccctacgggtgactctgaggcccgtgcccaccttgggtgacactgaggctgccccatccccgctacgggtgactctgaggctgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccctgtc

SEQ ID NO: 382524 - DNA, 2419 bp, Homo sapiens
accttctgtatcagttaagtgtcaagatggaaggaacagcagtctcaagataatgcaaagagtttattcatcacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 382525 - DNA, 3847 bp, Homo sapiens
  misc_feature (3030)..(3031): n is a, c, g, or t
  misc_feature (3039)..(3039): n is a, c, g, or t
  misc_feature (3046)..(3046): n is a, c, g, or t
  misc_feature (3050)..(3050): n is a, c, g, or t
  misc_feature (3052)..(3052): n is a, c, g, or t
  misc_feature (3054)..(3054): n is a, c, g, or t
  misc_feature (3075)..(3075): n is a, c, g, or t
  misc_feature (3077)..(3077): n is a, c, g, or t
  misc_feature (3087)..(3087): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgaaaaaaaaaaaaaaaaaaaaaaaaaaaannaaaaaaanaaaaaanaaanananaaaaagaaaaaaaaaaaaaananaaaaaaaaanaaaaaaaaaaaaaaaaaaggggggggggccccagaaatattccccccgaggggccgccgccaacatgtccgccgccgcgcaccccagcgatatttatgtgtgatagaagaggggcgccccacaatatagaggcggagcgcgtgaatattataaagccgaagacgccgatgggcgcgcgtagtaaaaaaaacaagacgagacaaggggagaaaaaggcggcgaaaacagggagacacttgggaagaagcagcgccccaactcatctcgcgggggggcggcgaacaccatatcgggggagaacaacccacccacaccagagactaattaacaaggcccacaaaggggacaaaactaataaacaactataaagaggggtgataaccaggggcggaaacacaccacagcggcccacacagagcggcgggacgcggacaagcaaaaaacagcttcggggccaccacgcggggacaataatcgcacacctcgagagcaacacaccacttatccaaccccggggggagcccagtcgtggcaaacaaccccaccgccgcccgcccacaacgccaacacagaacaacgaacagaccgcaggcgcccagcgggagacgcagagcaaagcagacgaacgaggggagaacgaagcacacgaaagcaacgcacaaccgcacacccaccaaagccgagacgggaagaaggcaaggcagaagggagggagcggcgaaggaggcgaaagaaagaaaaagcggaagacaaagcaaca

SEQ ID NO: 382526 - DNA, 3237 bp, Homo sapiens
  misc_feature (2690)..(2690): n is a, c, g, or t
  misc_feature (2692)..(2692): n is a, c, g, or t
  misc_feature (2702)..(2702): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgaaaaaaaaaaaaaananaaaaaaaaanaaaaaaaaaaaaaaaaaaaaaaaaaaaaaaggggggggggcaaaaatttctcctccagagggcgccccacagtctctgcggcgcactccccactgtttttgtgtagaaaaggagggtgcccactactcgtggggcctgactattatactcctcagagcgacagggtgcgagctcatatcacaacaggcggcgcagacgcaggcgaagcacaacggcgactcgctccgcagccaacccctttgggcgctacacaacgcacccacccctcatcaccttccggcgggggcgcagcgagaccacacacctcctgggcccccccaccctcacccccgctaccccgcccgcgataccatttcagacacccgccgtaccgatgcggcaccacactctacccacgctccttctcgaccgggcggctatatcaacccgtggctctccccacacccaccacagccccgcctactgacctgtcacaccccccgcgccccaccaacgacacatcttcgcccgcccccccctgccagcatccctcccc

SEQ ID NO: 382527 - DNA, 3184 bp, Homo sapiens
  misc_feature (2761)..(2762): n is a, c, g, or t
  misc_feature (2770)..(2770): n is a, c, g, or t
  misc_feature (2777)..(2777): n is a, c, g, or t
  misc_feature (2781)..(2781): n is a, c, g, or t
  misc_feature (2783)..(2783): n is a, c, g, or t
  misc_feature (2785)..(2785): n is a, c, g, or t
ctcaattggaggatcaaagttgagaaaagtaatattcgacatttttcgattcaacggagtggccaccaagacgatgtcatagaagtctgaacgagtctcagttccaatttggtagaccacttcatacatctttgttggatttcctgtgtacttggtctttgttttctcctcgatgtacattactgagccagatataagattgcttttggatgcctgcagaagccctgagcaaacaagtttattgccaccttctactgcccaaaggccagaatcagaacaggacagtgacaccgcccccacaaaggcattgatgtccgtgctttggccataattgaccctcataacaggagcaatcatttcattgaggaacttctcagaaaagccggccttttgcaaggtttcaagaagtgttcgattaagcattccaaggaagtcatctcctcctagagcatgaagtaatttttcgacactactgaaggcatagtcatgagactggtagcggtagatcctcatgaacttgtctaacacgtcctctacccacatgtgcatacggagggattgaaatccatagcgccaaactaatttaatcacgttaattatgaaccagttgctctcctcaaataccagagtctctccattatatatccccagtacacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgaaaaaaaaaaaaaaaaaaaaaaaaaaaaaaaaaaaaaaaaaaaaaaaannaaaaaaanaaaaaanaaanananaaaaaggggcgggcgcgcgcgcgcgcgcgcgcccagaagaaaatcgtcaaaacaaacccgcggggggggcgcgcggcggccccccagagaaaggaggagagaaagcaggggaacaagagggggaacacaagaaaagcgcgggagaaaaaacaaaagcgggggggaaatccaccacacaaaagaaaacgcgccggggggaaaacaccagagagtcatgcagaaaaccacgcgaaagggaaacgagagacacaaagcggaggcgccatacacaaagggagagacacaccaagggaagaggcgaaaaaacaaataagcgcacacgggcgctgggtggacgacagcaagcggaaagcaacagagacaacagaacaacagagaacacgcgcaaaccgaacaagc

SEQ ID NO: 382528 - DNA, 389 bp, Homo sapiens
agaataaaactgacataaaacataacaaaaagaaaaaagcataggccaggcatggtggcttatgcctgtaattctagcactttgagaggccaaggcaggtagaattgcttgagtttgagttcgagaccagcctgggcaacatagttgaccttatctctacttaaataaaaataatcagccaggcatggtggcatgtgactgtagttccagctactttgggaagctgaggtgccattgcactccagcctggtcagcaagagcaaaaaaaaaaaaaaaaaaaatgtgcacatcaaagatcatagccccggcacatcgaagctgcaatgagctatgattgcatcacttgcactccagcctgggtgacagaatgagaccccgttgcaaaaaaa

SEQ ID NO: 382529 - DNA, 1199 bp, Homo sapiens
ctgggactatgggtgcgcaccaccaccatgcctggctctttttttttctggagacagagttttgctcttgttgaccaggctggagtgcagtggcgctatctcggctcaccacaacctctgtctcccaggttcaagtggttctcctgtaattctagcactttgagaggctgaggtgggcggatcacttgaggtcaggagttcaagaccagcctggccaatatggcaaagccttctctctatactaaaaatacaaaaaaaggcggaggttgcagtgagctaagattgcgccatggcactccagcctgagcaacagcacaagactctgtcttaaaaaaaaaaatgtatttatctggaagacaaatgtcaaatcttaatagtggttatccctggattagagcattttggtgtgttgctttcctggtagaatattgttttaatgaaaatggatcaaaggaggacatagatgggtgaaaaccatgaggaattgactttgacattcttaattgcatcagcagaaatagttaaaaagtacttctaaaaccacttgcatgaactaggtgtttaaggggaaccgctcacgcttattctcagatacattaataaaaggacacttgaagtctatgaagaagatagctgttccagccttaccgcacattttcttcctgagtgaaaataggaacttatgtattggtggccatcttgacatgaaactacaagatccttcccaacagtatcatcctacactgaaacctggaaccaaatccattcccattcagcaaatgttgatcaagtggcatgtaggggatacagagatgattgcatacaaagatgaaaaagaaaacgtttctgccagggccaggcgcggtgactcacacctacaattccagcactttgggaggccaaggcaggtagaattgcttgagtttgagttcgagaccagcctgggcaacatagttgaccttatctctacttaaataaaaataatcagccaggcatggtggcatgtgactgtagttccagctactttgggaagctgaggtgccattgcactccagcctggtcagcaagagcaaaaaaaaaaaaaaaaaaaatgtgcacatcaaagatcatagccccggcacatcgaagctgcaatgagctatgattgcatcacttgcactccagcctgggtgacagaatgagaccccgttgcaaaaaaa

SEQ ID NO: 382530 - DNA, 981 bp, Homo sapiens
tgagagataggagactatcattgcaatcctggtgggagtagatgctggcttcatccagatggtactggtagtggtagaagtaatggtcggatactggatctgtttccaaggcaaaactaacaggaattggtgacagtttagatgaggggtgagagagttaaggttaactgtgaggtttttggtctaagcaactggaaggctgggaaagattttaggaagagtagattaggagagggattgaggagaggaggtcatcctgacctgagcctcagatatcttaaatttgagatgccttaagggtgtctcattgagaaggcgatagggtataagaatctagagtccagaagagacgtctaggctgcatatatagtttggggcattatcagcatacatttaagagtacaaattggatgagatcccttgtgtgtgactgcagagagtgaaagattgagcctgaagcactatggttcctaaacactgaagccagaaggatcgaggatgttaatgggtcgggctgactcccaggcagacatccgtggccattcagggactgtggccacctcggttgacaccacagatggctccccattgctggagctgtgtggtgtgttttagcttcataggaaaaaggggttctcttatgagacagatgggggttgggggattattctctttttcctgacatatgcagttaactcggccaggacaggacagtggaatgcacataattgaaatatcctccggagcctgcctgaatgcagaagtctctttttgcccagtattttcagccagcatccagactcctaaaaagcagccagccgtgtggctaactgaactttcaccccttttttgttcttttatatattatttcttagaagaattaattagtagagaggataaaaatcctgcgttggtagtgaagaaaggaaactcaatgcataccctgaacaatcctcagaataggtcaacagccccaggaaa

SEQ ID NO: 382531 - DNA, 267 bp, Homo sapiens
tatctgctagggcacctactacgttggcttgccatcatttgtaatccatctgtgtaaacacaggaactgtgtctatctaggctgtaagtccccagggctcagcacagggctggcatcccagtaagaggctatcagtgccaatggaagaaggtgccccatgctgtattactgttgttttctgggatagaggagtctttcctctaggatggagagcagagcagtgaagaagcaagcagtcccttacatcatctggctgactgtctaatt

SEQ ID NO: 382532 - DNA, 281 bp, Homo sapiens
ccaaattgggtaagagaaagagaaacatttattcctgatatgaccatcatatatatgcatgtatatatacatgcatatatatacatataggcctatcagatgagaaaaatccaccagcgacccagaacttacaaaacagaaaacatttttaagaattcatggataggccgggcgcggtggctcacgcctgtaatcccagcactttgggaggccgaggcgggcggatcacgaggtcaggagatcgagaccatcctggctaacacggtgaaaccccgtctcta

SEQ ID NO: 382533 - DNA, 354 bp, Homo sapiens
tctcagtcttggtgctgctggcctgaaggacagtgtgcagtttatgagaggctagctttgaaaatggcaccttcctgtagcttcttaggtcttataaatggtgtgggagctccctccctggagcagccctgtcccttcgtctcccatcaacttcctgtgttagtttcagggcttgggatggtcaaggggctctcctgtggctaggattgcatgatctgatggtggggatgtgggctgctggaagtctgtcactcaccctttcctcatgttaggaagtcactcccagctcttagccagtcctgaccagggatgctgcctcttttcctccttccccacttttggtgtttcctgtct

SEQ ID NO: 382534 - DNA, 499 bp, Homo sapiens
cattttcagagtgcgtgtgttgggtggggttgagggagaaggatgaaggatgacccccaaccccaacaggagaattcaaaaatcagagagcgatgaaggtgaacgcgctcccctcccccgctgtcgctgggaagccccactctgcccaggtctggttcctggagcatcagcgccccctttccctcgccggcaggatcgtttcctcccgacactggcctctcgccttgggcgcagggtttggggctcagctgtcaattccaaggaattcgtagggttcgacccacgcggcgggagggaacggagggagaatcaaaaggcatcctcccccacgacgcggaggcggtggtacgattcctcaaacgcccaagcttgagctttttttgtatgcgagatagaagccagggcaacctcgcccagataaccccgaaaacaaaggcacgaccagataagtgacttcaagggagtaaaggtcgttctatcggagaacgttccaaaccta

SEQ ID NO: 382535 - DNA, 466 bp, Homo sapiens
ggaaaacaaacaaacaaaaaaaggcttagagctggaattacaaaatcaattgtctacaaaggccaagaacgtgatgaaaacaaaagaaacgagctgagtggggactgacggaggtgaactgtttttaaaaaggcccttgctctattctaaaggggggcagcacctagacaagtctagctgaaatcaggacataatgatgctatgcagaaatcagaacacaatgttaccagatgttccaatccttcaagaaaaactgaaatttggattttgtcaattctgatttttaaaaacaaacagatttttaaaattttgaaatattgtgtgaggttaagaaggtgcattttgctggcggtggtggctcacatgtgtaatcgtaccactttgagaggcagaggcaggaggattacttgagcccatgagttcaataccagcctgggcaatatagtgagacctcgtctctacaaaa

SEQ ID NO: 382536 - DNA, 591 bp, Homo sapiens
gaagtggcctggggcccagaataagtttgagtggcagttaggtcacaaggactgcagtccttgggcaagccctggtgctgcagtggtctctaaggctgtggactttgggtgcatgtgacccagcatgacaccagccgtagcagccaagggagtgtgccacacccctcccccaactccaggcagtgtggctcagaaagagactccttctgcttgaggaaaggagagggaagagtacagatgactttgtttttcaacttgagtaccagctcagtcataggaaaataaagcgccaagtagaatcctgaagccaccgatcccaggcctttcttcctggacagtgcggctagacccaacccaggccagaagggaatctgctgtcctggttggttggacacaagttctggctggttttaccacctgctgactaaagtggcctcaagccttgaataaacgtcagtggcagtcaggtagtactgactgtggaccttgggcaatccccagtactgtgctgtcatagagtccatgggtttagactagcattactgtgatgccagctgtgatggacacaggagtccctgtgtcacgtctccc

SEQ ID NO: 382537 - DNA, 404 bp, Homo sapiens
ggctcactgcaacctccacctcctgggagggtcctttgccatgtggtagtcagaccctctcaaaatcctttaaccaactcccattctaagctataataaactatttgtagttcttcaaatatgcattttaaactaaagatcttggtagctagggcctagttgccttccaaaaatatgacagttaacactcccaccaatagcaacatgaatgtgcttgttccccaaccgcttgccaatgctgcgtgttaccattctaacataaatagagtatatttaggatgttttgtatgccgaaccaacgttgacatactaacttttatgtggttgtacaaaaaccagtatgcagttgagaactgatgaagagattaaaaagtcgtgcttgtctttactataattattttgtt

SEQ ID NO: 382538 - DNA, 366 bp, Homo sapiens
tttatagtccatgattaattatgatgataatgatagcaaatcttcatttgcacttactgcaaagcactattccaagcagtgtatgtgtatataaaaatggcttaatcctcacaatgaaatagatactgttattatccttccttttacaaatgaggatgccaaggcacagggaggttaggtttcttgcccaagattacacagtttgcagctaataatttatagatgcgggtttacaaattcaggaaaaaagagagttcacagttaacatttgtgtcaaatcgcatgagatatgaagcatagacaaagtgaaattaagcaggatggtctaggatttctttcaaagtcatatttaagggcttcattaaa

SEQ ID NO: 382539 - DNA, 418 bp, Homo sapiens
tgctattgatatgaaaactacagcaattcagcgtttttttcagcattttctccctttatttatatagttggagactcaaaggccaatagaagttaaattacttccatggggttcacagtcctaggcagcattgaataactgcccttcaatgggcatggctatgtgccagtcactgaactccacactctattatagagtgtctctggaggggttatctgatgagctcagatagcatcagatatgcaggaaattcgtagtggctttatttctctatacatgctttgacttttctgatagtccctctacaccttggatagctgtgacaatgtacacgtgcccattgttcttttaatattttccagttctagtcatctcttttcagtttaatcatttagtatattcaaaaaacaacttctga

SEQ ID NO: 382540 - DNA, 522 bp, Homo sapiens
gcacaagggtttatctgggacctctattctattctattgatccatatgtctgtccttatgtcagtaccacaccgtttagattactgtaacttgggatcacttaacctatttaaaacacgttttttctttttcttatttgaagtatttttcagcaaatatcagatggtattattttaccccttcataattcagtataactctaaaaattatggcccactacaaaaccacaatattattatcactcataatgtttctttggcataatctcatacctggtcttaatcaaatgtatggattttctcaaaaatgtgttttctggcttacttgaattaaaatctaaacaaggtccacattttaatatgtttgttttttaggtcactcgtaatttagaatagttcttcctctgctcccttttccttcagccattcacttatagaaattagtttagttgttctatagaatgcctcccattctggatttctctaattctttattatgtcttttaacactaaatggaaatta

SEQ ID NO: 382541 - DNA, 532 bp, Homo sapiens
aaacctcttcagagtactgatgaccataaagataattatagtgcagatctctccatctagatgaggctccatacctaaaagaacagaagatggctgcaaaatatctggggaggggaaaaaaaaaaaaaaaaacagagaaagcccgaaaagtaaaatgaacccattgtatgagtgcttgacaccaaatcactgtcatttactaagtaatgaataaaatacatacacacacataaaaatatatgcaccaaggaattgctaggtccaacacaagtaaatctctgtaaatttgacttttagcaagtagcacactatacaatctaataatgacagggtgttgttttttggatgttcttcttctgtaaatttactagagagggaaggaatgaaaagagggctcttgtctcccatgactttatacatgcagtagtacagtagagttgcaggatcaatcattgaggactattagaggcagaaggctctgggtgtgttgtcccagttctgccctgccatgtgatgtcaccttgtttttctc

SEQ ID NO: 382542 - DNA, 673 bp, Homo sapiens
ataaaatgaagctgcttccaatattattgactcagaaatgtaaaatatagcacagtttatcttgtctgtggtcctgtactaagttaaacttgcagctgtgaacaaattaatatttatttttattaggaattctttaagatgaattttcagttttagtaaaagaaagacaccagtgatatttttatggatgaaagctctctggttccttcagcagctctaggaacatccttagccattatatcctctctctttgacaatatcaaaattgtccaggtaaatgtaatattgccagtggtgtcaagacattggtctgttcatgtccttattcttcgcttggtttgtggaatcaaaatggttgcttattttcctctcttctgtagataatccataggcaatgttttcaatttgggaaactttttttttcaacttggtttaagtttgaaggctctaaggaagaggaatattagaacaaattatgtattctctatgttctactccacttgtttgtaatatactcctgttctgagagttatggtaaacctatataacacgactgttccaagtgccaagtgagaattgtagtgactcacagaacacgtctcatgactatttatcaaaagaaatgtgctgattaaagaaaaaaagtaaaatatcttattttcaaaaaaaaaaa

SEQ ID NO: 382543 - DNA, 532 bp, Homo sapiens
  misc_feature (15)..(15): n is a, c, g, or t
  misc_feature (22)..(22): n is a, c, g, or t
ttaggtggtaccccncgggtantttgatcgctgccgtcgaggcgaggtcgaagcggccgtcgaggcggctgctcttgcctcccctcgcttcccctctccatcagcagcccaagggtgtggctccccttaccaacccaggttggaggaggagacgcgcaaggggaggacgcggacacaacctcgtgctcttccgcaaggacgtggacgatgccactctgtcccgcctggaactagagcgcaagattgagtctctgatggatgagattgagttcctcaagaagctgcacgaggaggtaagtgggcccggtatcaggggcggtttctgaggttgtggggtggtctcgctggagctggcgggtggagcggaggcatcgccctggggatcaggacgatgctgggtagacgcagcccctccaccctagtctacaggtggttagactcccacccttgcgccacctggcggcgggcagcggggctgtacctccgaaacctggcctctggtctcgcgcccgcgggggcgcagggctgtacg

SEQ ID NO: 382544 - DNA, 1582 bp, Homo sapiens
agctctgcgaacggtgactgcccatccttggccgcaatgagccaccacccgtcgggcctccgggccggcttcagctccacctcataccgccgtaccttcgggccacgcgcagaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaaggggaggacgcggacacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcggggctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 382545 - DNA, 914 bp, Homo sapiens
aaagcctgggttacccccacttctcagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcggggctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 382546 - DNA, 1790 bp, Homo sapiens
agctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaaggggaggacgcggacacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcggggctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 382547 - DNA, 1650 bp, Homo sapiens
  misc_feature (15)..(15): n is a, c, g, or t
  misc_feature (22)..(22): n is a, c, g, or t
ttaggtggtaccccncgggtantttgatcgctgccgtcgaggcgaggtcgaagcggccgtcgaggcggctgctcttgcctcccctcgcttcccctctccatcagcagcccaagggtgtggctccccttaccaacccaggtgtgtgcgggcagcatccctgcccacgggctccaagtgccccccgctacccctttgctctgagtgtttggggaggtgggagaagtgggtatctgtgcctcccctgagtaatgaggaaacccccttttcagctcccagtccgttagagacaatgcggggcaattccattagacagcctcagccctccatttagagtcctgggcagcagaacagcctctaaccggatcctggggggcgtgcggtctggggtgcgagctgggcggcgaccccgcagttcagcctctgcacgctcttcccgtcaggttggaggaggagacgcgcaaggggaggacgcggacacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcggggctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagagaaaactctccagtgca

SEQ ID NO: 382548 - DNA, 562 bp, Homo sapiens
ggtggttcttccctcatgaatagatcaatgctattatcgtggaagtgggcttgttattgcaggagtaggttccttacaaaaggatgagttcagcctccttttgcctctttctctccctcattctctttttgcccttctttcatgggatgatgcagcaagaaggcccttgccagatgccagcaacttgatattgaacttctcatcctccagaatggtttgtttttcctctctgtcatacctcaagaggaacacaaagagtgatggcctgtcactctgatgcctctctctactcaaatggcagaaaccaaccaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382549 - DNA, 735 bp, Homo sapiens
ggtggttcttccctcatgaatagatcaatgctattatcgtggaagtgggcttgttattgcaggagtaggttccttacaaaaggatgagttcagcctccttttgcctctttctctccctcattctctttttgcccttctttcatgggatgatgcagcaagaaggcccttgccagatgccagcaacttgatattgaacttctcatcctccagaatggtttgtttttcctctctgtcatacctcaagaggaacacaaagagtgatggcctgtcactctgatgcctctctctactcaaatggcagaaaccaaccagttaggttctgtcaatagaagatactaaagaaagaaagccaggagaagaaaagggacttctttcttcaaggtctaagctgttctaatagcattattctgggaatggcatcttccactcctcctagtacaaagaacctgcttcctcataccccgtcaaggaactgcagcatccaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382550 - DNA, 464 bp, Homo sapiens
ggtggttcttccctcatgaatagatcaatgctattatcgtggaagtgggcttgttattgcaggagtaggttccttacaaaaggatgagttcagcctccttttgcctctttctctccctcattctctttttgcccttctttcatgggatgatgcagcaagaaggcccttgccagatgccagcaacttgatattgaacttctcatcctccagaatggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382551 - DNA, 464 bp, Homo sapiens
ggtatccatgttggaatctctcatttgattcttattcaaatttaggttctgtcaatagaagatactaaagaaagaaagccaggagaagaaaagggacttctttcttcaaggtctaagctgttctaatagcattattctgggaatggcatcttccactcctcctagtacaaagaacctgcttcctcataccccgtcaaggaactgcagcatccaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382552 - DNA, 368 bp, Homo sapiens
tgagatgaacccggtacctcagatggaaatgctgaaatcacccgtcttctgcgtcgctcaggctgggagctgtagaccggagctgttcctattcggccatcttgtctcctccccaggagtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382553 - DNA, 845 bp, Homo sapiens
ggtggttcttccctcatgaatagatcaatgctattatcgtggaagtgggcttgttattgcaggagtaggttccttacaaaaggatgagttcagcctccttttgcctctttctctccctcattctctttttgcccttctttcatgggatgatgcagcaagaaggcccttgccagatgccagcaacttgatattgaacttctcatcctccagaatggtttgtttttcctctctgtcatacctcaagaggaacacaaagagtgatggcctgtcactctgatgcctctctctactcaaatggcagaaaccaaccagttaggttctgtcaatagaagatactaaagaaagaaagccaggagaagaaaagggacttctttcttcaaggtctaagctgttctaatagcattattctgggaatggcatcttccactcctcctagtacaaagaacctgcttcctcataccccgtcaaggaactgcagcatccagaatacattcatacctaacacctcaatagatgacatgttatccatggaatcgagttcaaagccctctgtaacgtggctatatcccatctactctgagctgatgttcagcaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382554 - DNA, 893 bp, Homo sapiens
ggtggttcttccctcatgaatagatcaatgctattatcgtggaagtgggcttgttattgcaggagtaggttccttacaaaaggatgagttcagcctccttttgcctctttctctccctcattctctttttgcccttctttcatgggatgatgcagcaagaaggcccttgccagatgccagcaacttgatattgaacttctcatcctccagaatggtttgtttttcctctctgtcatacctcaagaggaacacaaagagtgatggcctgtcactctgatgcctctctctactcaaatggcagaaaccaaccaggtacatcccagccttcttgcacatagaaacactacacagcacttcagctgtatgtttgggggccattttaaacagcaaaatcatcaacaggaagcagaaaattgtaaaaattgtggcactaaatagaccatgtaaaggacacatgtttgcaataagaaagctgaaacaagaagggggagtgtcaccttatttgatccagctagaaactcaggtgctggtattccagcaacactcaggcggctgctccaggaggctgcagaggggtcctttttagccgtcaacaaaactggctatggtcacgcccattgggaaactcattgctgccttcaaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagaatatgcac

SEQ ID NO: 382555 - DNA, 376 bp, Homo sapiens
ggagttttgccatgttgcccaggtcggtctcaaactcctggactcaagcaatccacctgtctcagcctcccaaagggctagggtacaggcatgcgacaccgcacttggctaggaataataatattttaaaacaacaacaacaacaatgtaaagttttcattctctggaaatccaattataaattccaagcatgggaaaaaaatgactcataacaaggagaaaagtcacttagtaaaaacagatccagacatgacagaagtaataaaataagccaacaaaaacattaaacagctattacagatatgctgtaaatgtatatgaagatagaggaaagcatgaacctgatcaagagtgacataaaaagacccaatttgaa

SEQ ID NO: 382556 - DNA, 270 bp, Homo sapiens
cgaaactgcatctcaacaaaacaaaacaaaacaaaacaaaaacacacacacccgacactctgcagttcaacctccccaggcagctgcgttcaagtgcagtaacggaggggcctgaggagtgcgtataaggagagattcttctaataagagaccgtgaggagactccttgaggaggcagcatttgacatggagtttaggacagaagagatttggacagactgagctaggcaggaagaggaaatggcatgggcaaagcatggcaggtgagaa

SEQ ID NO: 382557 - DNA, 509 bp, Homo sapiens
ggctcggtacctcaactactgtatctaagtgaggtttcttccaaggagtaatttctcttatttgactcttttgagatccttttctcacataattgtcaaatttcaattggagagaaactgtgttttctacctcattacggggtcagtgctgaggagagtaggaactcaggaaatgcttcttggttgactttagtctgctgtattgggtgacaaattgaccacagaccaaataacacgttggaatcctcttattctttctagagatctgggctgagaattaagggtttatgcttcttcttaaaacccgtttcaatctttcatgcagttatgattctcatacaaacaaatggaaatggggaattagtctttcaaattcagtcctttggctggcacagtggctcatgcctgtaatcctttgggaggttgaggtaggaagattgcttgaggccaggagttcgagactagcctgggccgaacatacataccaagaccttgtctctaccaaaaaa

SEQ ID NO: 382558 - DNA, 138 bp, Homo sapiens
aggtgaaatgagttcaggtagatccagagagacttctctggggaggtgacattatttattatccctgggaaaaggagggagcttgataaataattttaaagatacactagccaattgagtgaatgtttattgagcacc

SEQ ID NO: 382559 - DNA, 756 bp, Homo sapiens
ttttatacgtgtagagggtatgcgctggtcttgaactcctgacctcgtgatccacccacctcggcctcccaaagtgctgggattacaggcgtgcgcaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaatgtga

SEQ ID NO: 382560 - DNA, 652 bp, Homo sapiens
ttttatacgtgtagagggtatgcgctggtcttgaactcctgacctcgtgatccacccacctcggcctcccaaagtgctgggattacaggcgtgcgcaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtggtaagacatatgcttaattgcttttttttttatattacaaaggcttttttttgaatctt

SEQ ID NO: 382561 - DNA, 702 bp, Homo sapiens
ttttatacgtgtagagggtatgcgctggtcttgaactcctgacctcgtgatccacccacctcggcctcccaaagtgctgggattacaggcgtgcgcaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaacccagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaatgtga

SEQ ID NO: 382562 - DNA, 472 bp, Homo sapiens
atcttcacagctagttctgcagaagagaaaggagcattttggtcttgaggtaactcccagtcggtctccagcttcctccagatggaactctgccctgctgtagcctctgtgaagaccagctgcctctggctttagcattttcctgcagctaacaggcatcagcccggagaacaattgtcttggaggagagagggagagtctgggctgaaaactgccatgcagggatgggagccatttttaaagccctcctgaatgttcagtatgtctggggctcggctgccaagggagttgacctccttgaggacagcagagtccagccctctgtgcagggagttaagcttctggtgtgcctattttcgtagggaagaagaaaagagagggcacaaaacgaatctctatccctgtcgaaatcctaacaaaggccgggcacgatggcttgtgcctgtaatcccagcactttgggaagctgagg

SEQ ID NO: 382563 - DNA, 352 bp, Homo sapiens
ctgtgagtttgtcatagatggcccttatattttgtggtgtattccttcatgcctggttgatggtttttaacatgaaagaatcttaaagttttttcaaaaccttttctgtgtctatggttaacgttttctttcttttttttttttttttttgagacagagtctcactctgtcgcccaggctgaactgcagtggcgtgatctcggctcactgcaagctccacctcctggactcacgccattctcctgcctcaacctcccgagtagctgggactacaggagcccgccaccatgcccagctaatttttttgtatttttagtagagacggggtttcaccatgttaaccaggatggtc

SEQ ID NO: 382564 - DNA, 233 bp, Homo sapiens
acttaatgccttttaaatgattggatgaggccattcatgttattgagagtaatctcctttacctaaagtcaactgattacagatattaaccacatttactaaataccatcatagcaacaccaagataagtgtttgactaaataagtggatattatagcctagccgagttcacaaataaaactaatcaccacaggtaaggaagccacaactgttatacagcatgggttagtttt

SEQ ID NO: 382565 - DNA, 744 bp, Homo sapiens
ggtggcaggggatagggtctccctctgtctcccaggctggagtgcaatggtgggatcttggctcactgcagctttgaactcctgggctcaagcgatcctctcacttcaacctcctgagtagctgggactacagggcttcttcgctggaatgaggaagaggaggaagccaaggaagacagagactgtggcatcagtacggtagcctttcctagtaaagagacaagcatagctgaggagaagggtcaggaattttcaggagtaacatgatgtctcggagcagtctgtccgaacacagtgcctctttttaggacttatctagaggtaacattaagcttagttcttgccagttgctgccacgctatccactttggatttaatgggcaatggcgaatgtctggaggcagggcctggctagagtagatgtcttaatgtgaatttgtgagcccgttaattggggcaagtcctagatggagtgatcaggagtggagttggttagataaaggagaatagaagaggatgagacctctttcctatgaaggccacacctccatgtgcctcccttctcaagtgagaagttgatttcttctttacagttggtactttatagatgtttcctcctttaactttcataaccacctatgaggtaaccaagcttccaagagcttatgtaatgagactacatgcagcactggattccaaccccagaccgggactccaaagagtgtttttccttcctgatttcac

SEQ ID NO: 382566 - DNA, 512 bp, Homo sapiens
ctgagagtatagaccagtttatactaggaagtgggattctcttctgcatatggccattccctacatgcagtcttaaccccagtgaggcagaattcacagtcctcctctgaatgcactcttcagtttccttcacttgaatgttttctccattcccattaggactagccaaagtcacatctctttttgagtcatgccagccccatgtcttgtccatgtcattcatttgcagatagtcatattcccctttggggcagaaaccatattttagttatctcaatgcttagggaaaaccttgtatgtagtggatactcagaatattttcttgtgtgaattaagtatgctttgcatttgtatctaactctgagtaactctgagtcctccaccctccagaagctcacagctttagattatcacctttcttcttgaaatcattgtgaactcctagagattggtctgtgccttatttttcctgtatcctttcagtaccccatatagttttctcagtcaggagg

SEQ ID NO: 382567 - DNA, 408 bp, Homo sapiens
tcctaccagtatatatacctaacagctatcaacacagagcttgcttggctcatattaaaccttcattaaatgaatgaatgtggattatgcaattgttgtagtaaattactctttgaaacaaggtggtgggagatttgttataaggttctagaaagttcaccttggcagggggaactaagggataagatatctaacttccctttataatatctcttttctcaggctgtgtactctgtaggcaatctcaatttcttacataattttgtgagtttataaaataaattattttttgcttaagccatcttgggatagttttctgtcacttgtagtaaaagttattgagtaacaatgctccttgcttgtattttgttccacttactccaggtatcttccttgtggtgttttccc

SEQ ID NO: 382568 - DNA, 862 bp, Homo sapiens
accctgcttctcccagctggagtaggtgggggaggccagacatggaggcccttcctccagtcagatccagccttttggggaacctgttgcaggttacgaggctctcagtgctgttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctccgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacttggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcctctcct

SEQ ID NO: 382569 - DNA, 985 bp, Homo sapiens
accctgcttctcccagctggagtaggtgggggaggccagacatggaggcccttcctccagtcagatccagccttttggggaacctgttgcaggttacgaggctctcagtgctgagacagggtctcgctctgtcgcccagcctggagcgcagtggtgccggctcagctcgttgcagcctccaactcccggtctcaagcaatcctcccccctcagcctccaagtagccgggactatagttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctccgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacttggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcctctcct

SEQ ID NO: 382570 - DNA, 556 bp, Homo sapiens
tataaagaacccagtagaagagatcaatacattgttaagtagaagagcaattattactttgtgaaattttagttataaatagatgtgtgtagtaaatgacaatgtgtggggttttttttgttgttgtttgttttgatttggttttggattttactgtggcttgtgatcaaaaagtttgaaaaacagtgtagttggttccatatccatgtagagcttcctcatttgtttttaattgttacatagtatttcattgtatacagtatcatagttatacatatgtccaataggcaattaattggtttccagtttcttgctgattaaagctactttgatgaagattcttataaatatgttattttatatatataaaggcatatctgtggaataaatatctagaaatagaattgctaggtcaaagagtgtgtaattttgataaatacagtcaatcctcattattcctggattctgtatttgttaatttgcctacttgctaacatttatttgtaatccatgaatcagcatttcagcactctcatagtcacttgtggacatgcat

SEQ ID NO: 382571 - DNA, 868 bp, Homo sapiens
caggaacaggtgcttccatgattagggggaagggacagggagaatcatgcaatagttcgtgaagcttccacattactgtgcatttttcactgggcaggtgacagaaccaggatatttgcaagcagccctaaaggttaccacagtgggcaagcaataatatctgcatatccaaattaactgctctttgaaataattagaactcgttttactctagaaaatatattttggaaaagaacacacattggaataatgacgaaaaaaattgctttctgtattgcaaaatgtatacgttactttaacagatttatatcaagcacctatatactttatggcagaaattatgctaaatcctaagaatgaaacaataatgaaggcaaagctattccctgccaaaaggaacttagcgtttaacgaacaaagcaaacagatgaacaggtaattactgtacagagtgacccatattgttattgttcagggaattagagagggcacctaatatggtcttggggatgtttcagtaagtttcctggaagaaataacatataagctaagacttaaaagatatgtagaaattagctagaaggaaaggcaatggtgtgtgcatgtatgtgtgtattagtgtgtgtttgtgtttgtgtactgggcaaatagactattccatgtagagggaatattgagtactttatcaagactatagttagagtataaggaaagagttgacagtgaggcagcaccaaactttaccttcataaatagcaatttggttttatacttgtattagcatttttcccccttgagaatcaatgtccttgaatgtatttgccatttgctctaataataaaatacactttctataaccaaaaactta

SEQ ID NO: 382572 - DNA, 883 bp, Homo sapiens
caggaacaggtgcttccatgattagggggaagggacagggagaatcatgcaatagttcgtgaagcttccacattactgtgcatttttcactgggcaggtgacagaaccaggatatttgcaagcagccctaaaggttaccacagtgggcaagcaataatatctgcatatccaaattaactgctctttgaaataattagaactcgttttactctagaaaatatattttggaaaagaacacacattggaataatgacgaaaaaaattgctttctgtattgcaaaatgtatacgttactttaacagatttatatcaagcacctatatactttatggcagaaattatgctaaatcctaagaatgaaacaataatgaaggcaaagctattccctgccaaaaggaacttagcgtttaacgaacaaagcaaacagatgaacaggtaattactgtacagagtgacccatattgttattgttcagggaattagagagggcacctaatatggtcttggggatgtttcagtaagtttcctggaagaaataacatataagctaagacttaaaagatatgtagaaattagctagaaggaaaggcaatggtgtgtgcatgtatgtgtgtattagtgtgtgtttgtgtttgtgtactgggcaaatagactattccatgtagagggaatattgagtactttatcaagactatagttagagtataaggaaagagttgacagtgaggcagcaccaaactttaccttcataaatagcaatttggttttatacttgtattagcatttttcccccttgagactcttcccctataacatcaatgtccttgaatgtatttgccatttgctctaataataaaatacactttctataaccaaaaactta

SEQ ID NO: 382573 - DNA, 895 bp, Homo sapiens
ctctgcccattgggaaacacctctctatgactctataaatgtccaaggtggccccaagggaggacttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactcaatgcagacacatccttgt

SEQ ID NO: 382574 - DNA, 2038 bp, Homo sapiens
ctctgcccattgggaaacacctctctatgactctataaatgtccaaggtggccccaagggaggacttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcagccttccgagtagctgggattacaggtgtgcgccaccacacccggctaatttttgctttttttttttttgagacagaatctcgctctgttgctcaggctggagtggagtgcagtggcacgatctcagctcactgcagcctctgcctcccgggttcaggagattctcctgactcaacctcctgagtagctgggattacaggtgcctgccactatgcctagctaatttttgtatttttagtggagacggggttttgccgtgttggccggggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttt

SEQ ID NO: 382575 - DNA, 562 bp, Homo sapiens
actgcggcagtgctggctgtttctgcagtgtgtctagagagatcctgcggagggatcgaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactcaatgcagacacatccttgt

SEQ ID NO: 382576 - DNA, 337 bp, Homo sapiens
ttctttgagacagggtctcgctctgtcgcccaggctggagcacagtggcgtcatctcagctcactgcaacctccacctctcaggttcaagccattctcctgcctcagcctcccaagtagctaggatcacaggcgcctaccaccacgcctggctaatttttgtagttttagtagagacagggtttcaccatgttggccaggctggtctcgaacccctgacctcaggtaatccacccacctcagcctcccaaagtgctgagattacaggcgtgacgacagtgctcggctgtctataaattcttactttaaaaataaaatctaggctgggcatggtggct

SEQ ID NO: 382577 - DNA, 369 bp, Homo sapiens
ctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggct

SEQ ID NO: 382578 - DNA, 226 bp, Homo sapiens
gtctcccacatctggcccgtggtacacatcctctcacttgtcttccaaaccacattcatcgttccggttagttacaaacatgggctttctgaccctccccctgttggattctcctgctgcttcctcctgctccatgtggttcagaaacattggtcttctttcagttgcaggaatggaccatctccctccctcttgggaccttgcacttgttctagaatgttcttct

SEQ ID NO: 382579 - DNA, 409 bp, Homo sapiens
gcaaatttaaaaactttattatgtacatatatttttgcttataaaaaatatggaatgcttcatgaatttgcttgtcatccttatgtaggggccatgcaatctctgtattgttccaattttagtatatgtactgctgaagtaagcattgatttgcaagtattttctcccactctatggactgcctttttactcttttggtagtgtttcttgatatactctcaacaattttgtccacatgatttgttgaaatcaaggaaagcgtgggctgaaaaatccaaacaagtagggtgttagggctggcacttaaggcccagcttctaacatatggcccaggacacctgggagctggggttttatggggggaggagagttgttctgaggccaaggcaggtagtattagtgatattct

SEQ ID NO: 382580 - DNA, 1120 bp, Homo sapiens
tgctcaagagacggtaacaaccgacgggccgcgtggcctaatggataaggcgtctgacttcggatcagaagattgcaggttcgagtcctgccgcggtcgtagggaggttatgactaacttttagtttattcctccctcaggaacgaagtattgggacaatgtgaacgtagtcgccgccgattcccaccgcacttcaaagatgtgggaacgccaagatccgcggaagtaaccacgcccagcaagtccctgcgagattgcccgcctacgtgtctcagcggaggcacatttctaaaatgtaccaggtctctcgcaccccgacgcaggtggaggaaagtggagagggaggggcatcctgtacagaaatctcaatttatactcaattgatggttggcaagagttggggctcgcagccaaagcgaggctccctccctcgcccatccggtgctgcctcctcgtccagagcaattctgaggggtaaaaatgttgccttccgttgaacctgaatttgcccgcagatgctagcctccggcccacagcgcggctggagcttgtccccttccccagctgtttccagtctccgcatccgtcttgtgttgctccaggtgcttcaacagctctcagcgctcggtggttggtgaactgtggtaaagtgcacgcagaataaggtctacgtgattaagcaccgcctgggggttggggtctggaggcccagctgcacagatgaaagggaggctcagagacgtttgggaccaaccgagatcacacagctgattaggaataaaattcaggtcaagctgaaagtcggccgccaccgtccagcgtggatcccaggacaccgtgaacggactacagaagttgactttcgcgtttttaaggagtggggtgcagggaaacaatcctccgccggccctgcgggctgatgccgaccctcacctgctcccgccacgtggagaggtagagagaagccccgggccaagcagcattgagccctggtcccttctatttaaatatgaaatattttgcatacacttttctagatgtacttaatatacacaatgttttaatgtttgtgatttttttgttttgccaaaaaaatacaatcaatcagaaattcaaaagt

SEQ ID NO: 382581 - DNA, 841 bp, Homo sapiens
tgctcaagagacggtaacaaccgacgggccgcgtggcctaatggataaggcgtctgacttcggatcagaagattgcaggttcgagtcctgccgcggtcgtagggaggttatgactaacttttagtttattcctccctcaggaacgaagtattgggacaatgtgaacgtagtcgccgccgattcccaccgcacttcaaagatgtgggaacgccaagatccgcggaagtaaccacgcccagcaagtccctgcgagattgcccgcctacgtgtctcagcggaggcacatttctaaaatgtaccaggtctctcgcaccccgacgcaggtgcttcaacagctctcagcgctcggtggttggtgaactgtggtaaagtgcacgcagaataaggtctacgtgattaagcaccgcctgggggttggggtctggaggcccagctgcacagatgaaagggaggctcagagacgtttgggaccaaccgagatcacacagctgattaggaataaaattcaggtcaagctgaaagtcggccgccaccgtccagcgtggatcccaggacaccgtgaacggactacagaagttgactttcgcgtttttaaggagtggggtgcagggaaacaatcctccgccggccctgcgggctgatgccgaccctcacctgctcccgccacgtggagaggtagagagaagccccgggccaagcagcattgagccctggtcccttctatttaaatatgaaatattttgcatacacttttctagatgtacttaatatacacaatgttttaatgtttgtgatttttttgttttgccaaaaaaatacaatcaatcagaaattcaaaagt

SEQ ID NO: 382582 - DNA, 889 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382583 - DNA, 676 bp, Homo sapiens
  misc_feature (13)..(13): n is a, c, g, or t
ggcccccaaaganttgttctgcttgatcctcgatatgactagcggccacgctgccgaagtacaagagcaacacagttccaagacagtcgcagcccggctgaggctgtcggtgacggccatgaccggcttcactcgtgccgaattcggcacgagcctctgccaagaccaaaaggaaacaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382584 - DNA, 328 bp, Homo sapiens
gatccccgggctgcaggaattcggcacgaggggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382585 - DNA, 474 bp, Homo sapiens
tcttcgtaaatgacagcatgatatcaatggcaaatgcggggaaagtagacaaatcgattaccttctcggtctttgttgcttctgtggcaagtcctcccactcatctctttacattttagtcacctaaaaagaataatcataactgaaatcctggaaatcactgtctatttttaacctagaatagactaactaatatcttagccttaaggtgaatttaattgatgctctattttctttcagagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382586 - DNA, 1175 bp, Homo sapiens
aggcgtagtgagggggaagttgcagacctatgtaactttggaaatgagtagagtctgtcaaactaaaggtaaaagacaccgtatataaacactgtactccagctgataaaattgtttaccatgagaaaacaccattcagctgctttaagtttctgactgtccaggtaagaactgtttcaagccaaatatgaacagaagatggacggaggaaacacagtaaaagagagacgactctgtggctcacagagagcaggctaagagcacagttttgtcttggtttccagtttgtgctccactacttatcagctgtgtgatcttggccaagtgcttaatttttttgaaccccagttcccccatctggaaactacctcatgggaggtggcatcagttcaccctcttacacaacagctacttggtgattctgctgtctcttcaagggccttactgacgattcctcagtagaacctgttttcctgagtctcacttcagcaacataaagctaagtttggtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382587 - DNA, 1535 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctgggggggggcccgggacccaatttgcccttatggggggccgattaacattcaatggcccggcgtttaaaaccgtcggaatgggaaaaccctgggggtaccccacttaaatgccttggaagaaaatccccttttgccaagtggccgaataaccaaaagagcccgaccgaatggcctttccaaccgttggccaaccctgaaggccaatgggaaattggaaggcgtaaaattttggtaaaattcgggttaaaattttgggaaaacagctcattttttaaacaattggcccaaatggggaaaacaccttattaattaaaaggaatgacccgaaatggggttgatggttgtccaatttgaaaccaagagcccctttttaagaaccgtggctccaacgtcaagggccaaaacccgtatttagggcgagtgcccaatacggaaacttcacctaaataaagtttttgggtccaaggccctaaaggcttaaatcgaaccttaagggacccccgtttaaaactgaccgggaaacccgaaacccggcaa

SEQ ID NO: 382588 - DNA, 1484 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctgggggggggcccgggacccaatttgcccttatggggggccgattaacattcaatggcccggcgtttaaaaccgtcggaatgggaaaaccctgggggtaccccacttaaatgccttggaagaaaatccccttttgccaagtggccgaataaccaaaagagcccgaccgaatggcctttccaaccgttggccaaccctgaaggccaatgggaaattggaaggcgtaaaattttggtaaaattcgggttaaaattttgggaaaacagctcattttttaaacaattggcccaaatggggaaaacaccttattaattaaaaggaatgacccgaaatggggttgatggttgtccaatttgaaaccaagagcccctttttaagaaccgtggctccaacgtcaagggccaaaacccgtatttagggcgagtgcccaatacggaaacttcacctaaataaagtttttgggtccaaggccctaaaggcttaaatcgaaccttaagggacccccgtttaaaactgaccgggaaacccgaaacccggcaa

SEQ ID NO: 382589 - DNA, 894 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagtaaggaaatggtatcacaaagtgtattgcctggaaatgtatgcagaacaacttttagctacatcttcataataggtttgctgaaattaataacccttttagtaaaatcctgttccaatcccagctcttttctagaataatcactattgtgtaaagaactaaatgttttcatttaaatgaaagttcaaatggaatttagctgagtttaataaaagtaaattaaatccagaaaataata

SEQ ID NO: 382590 - DNA, 235 bp, Homo sapiens
ggactgatattttggcaactgtccatatctgactttgtagaaaacaccattcagctgctttaagtttctgactgtccaggtaagaactgtttcaagccaaatatgaacagaagatggacggaggaaacacagtaaaagagagacgactctgtggctcacagagagcaggtgtgattcatgcacattcaaattatgggctacaattttttaaaaaggtactgttgttttaggttct

SEQ ID NO: 382591 - DNA, 549 bp, Homo sapiens
  misc_feature (55)..(55): n is a, c, g, or t
gatccccgggctgcaggaattcggcacgagggcacgagccataaggaaagaaganaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaa

SEQ ID NO: 382592 - DNA, 918 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtggaaaaaattggcattgg

SEQ ID NO: 382593 - DNA, 552 bp, Homo sapiens
agaaagtgatggaatggaagggaaccttcctgcaaatcctcctgtaaggtggagaagccccttggatcacacttccacgcagacctgagcaggacacactgtggtttcctaagcccccgccccgtcagttgagcccgatggccttcctgctgatctgtaagcaggctgagcaacgcttgttccgcctggtggagagttcgttcttcttgggcccggggagctgcatgtcagggtgttgctgcttcgctcaagggtcacttatcacggaggcctctgtggtcaccctacagagcactgaccctctccactgctacctctgtctccccgactcaccctcatcctccatacaacagattgcatctgaaataatatgcattcgttattgcctgtctcctctcgtcagtgggtcagttctttgaaaatgagagccttgttttctcactgctgtgtgtcggctcctagaatgatgcctgttcataacaggcacctgatacatacttgttgggtagctaaattaatcagtgcttatagttcctgagagttatgccatga

SEQ ID NO: 382594 - DNA, 441 bp, Homo sapiens
aagtgctgggatcgcctcggcctctcaaagtgctgggattacaggtgtgggccaccgagcccggccaggatactgggagtttaaattcctgctgtgagcccaggttgacacagctggtcaaggatgggttagaatccaggtagtctgactccagagctactaccgcatactgcctcctcagattaaataattttcctaggacatgctaactgataagtaagagtctaaatcaaacccaggcagttgggttccaaaattccagcgtttaaccaccacattgactggttataagtaggtaaactgttcatcacaacctatatatttattttcatttctgttagaaatgaaagtagtgtggtaggttacatatttatcacatagtttaggcttgcctaaattctaagtattttcttttttaaattaaaaacaagggtctatcgg

SEQ ID NO: 382595 - DNA, 403 bp, Homo sapiens
aagccgtgcttccctgtgggggccagtggggctgaagggctgggctggcagtggggacggacatctagctgctcttgtgggtgccagggagcccaccctgctcccgtctgtcctctccctattgctgctttgctgcacaagctggagagtttcgggggacctggaacgtcacttgtgtgtggtaggtgagggaggaccacggatgcatcagacccagggtcgagcaatttctgacgtgtcttatttgatcccagcgacttccctgcacagaggttctcaccatcacattgtgggtgatgacgtgggcccaggggatcccctggcccctaaagggcaggcaggagcactgtgctgttccccagtagccttcagaccccacaccctgggttttttctgcaatgct

SEQ ID NO: 382596 - DNA, 192 bp, Homo sapiens
cctataccacaaatcaactagtgaaaaggagacctagctaattacatatgatggaataagcttctgagatatcaccacatcccatattcttggccataagttccccatgagttgaagagagggcctagttagggattcctagactgtacgttttgtgcctggagggctctacgccgacctctgagggggaag

SEQ ID NO: 382597 - DNA, 417 bp, Homo sapiens
atcccttgcgcttcgaccgagtgaggcaatgcgtcaccctgcttcagctcatgcacagtgcactgcacccactgtcctgtgcccactgtctggcactccctagtgagatgaacctggtaccttagatggaaatgcagaaatcacccgtcttctgcgtcactcacgctgggagctgtagaccagagctgttcctattcggccatcttggctgccctccgcttcccttgtttttaacagggagaattaagcctcttcattgtctttattctttttttttttttcaattgccctaacagtttccgagagcagtgttccgtgactcctcagttaagccaccagttcttccgagcccaacacagggtctttggtgtgaaaatttctgttttttccttattgctttaaaaaaaaaaaaaaaaa

SEQ ID NO: 382598 - DNA, 1453 bp, Homo sapiens
gctgagccttggccccggggctgttagaaggcagaggctctggggagaagtccccaaaccggatttacccgttcgtcgcacctgtccctaggagggcaggctggggtgtggaggcggtgccctgctgacccgcggggagagaagcccgggtctcccaggctgcaaaacgctcggcactgcggaagccgcgccaggctctcccagctcgatacgcagcggccggcgcgcctgctccgccgcggggccgagcggcagaggggcccggggctgcgtggaaggcccgggggcttcagcccgtgccggggaagccgacgctcagccaaccagaaagttagaggcggccgaggtctcgcggaggggaggcgcctggcggccacgggagaagtcgaagggctcaggcggggctccatccgcgacactgggagcccgggcgggcgcgcacgtgtgtatacgagtgcgtgggcccatccggcggcccggactacaagttccagggtgcccagcggcgctcccgggttttctggccgcgcctcccgctggctccgagcaggtcgccgctggctggcagtcgccacccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgtggacggctgcattcatcgggccgccggccccctgcttaccgacgagtgccggaccctgcagagctgtaagactggcaaggccaagatcaccggcggctatcggctcccggccaagtgtgagtccccgacgcgcccccagctgtggggcgcagacagggcgcccgtgtgtcactgggacatcaggggtgcggcccccacaggagtgctggggaactcctcagggggcccttcttaaccttaagggccaagacccggcccccaccccgcacacc

SEQ ID NO: 382599 - DNA, 438 bp, Homo sapiens
gtttctcctgcgcaagggcgcctggcggtggcgagatgggggtgatggcacacagccgtgagcctccgtgaagggcgcagggccaggcaggtgaaagcctgcaccagggcaggcagtcacaggatcctggggccaggcgtggcagctcggcccaggctgagcagcccctggcgcaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382600 - DNA, 1282 bp, Homo sapiens
taagtaagctgggtgttaatcggcgaggggctgcagtcgcaccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382601 - DNA, 1247 bp, Homo sapiens
taagtaagctgggtgttaatcggcgaggggctgcagtcgcaccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382602 - DNA, 974 bp, Homo sapiens
tacagccctaacttatggcgaggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382603 - DNA, 1488 bp, Homo sapiens
taagtaagctgggtgttaatcggcgaggggctgcagtcgcaccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggtgagggacggcccgcgggggagggcgggaggcggggcgcagtgacaatgttccaaccccctctcacccctccccgcccaggcgttcccctgcatctccaccggcgtgtttggtgagtctggaagaaaggcaaggaccaggagtgggcggtggacccagacgccgggaggggccggggcggacaggggagtgggcggggccagagcctaggactcactcccgccccacccgcctcaggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382604 - DNA, 1605 bp, Homo sapiens
tctgttgtgcttgtttgttctctcttctcttttatttgttttttttctttttcttttctttcgcttcgtggtgctctatgtgcctttttttctgtcgtctcgcctgttcctcgctttgttctcttttctcctcttattttctctgttcttctctttcttttttctttgtctctccgtctcgtgttttttctttttcttttttttttctttttttttcttttctttttttttttttttcgttctttatcttttcctcgctttttcttctctactctcttcttttgctttccttttgtcctgcgccgttccttgtggcgctttccctcttttctctcctccttgtgctcttttgttcttcttatttcctgttctctcgccgcttccctcctttcttgttctttccggccgcccccctctttgtgttgggtgttttgtttggtggtttttgttttttttgtgtgtgttgtgtgtttgtttttgttgttcttgttttggtgtggtggggtgttcgggtgtgttgggtgtttttttttttaaagttaaatctttctatttatttcaagaaagaacaaggcaagtggacttggacattttctatgaaaatagacaaacagaaaataggaccaagtagttaatcacattcatctcaacattgaagtttcaaggcacctacaagaaggaggccaaagggcggttcgcagtgcactttggtttgtgttgttgtcgtggtggtgggtgtttgcgtgtctcggttttctggaaacccttgcctggtggtgaggttgggagcgaagcaggtgggcacgaggccaggctggtctgggccctgagaagccgggccgggtcagccatctggtcgcatggcagcaggcggtagcggggacggtcaggcccgtcactcaggcccctgagacggcttccaagaaaaagaaaggagatagtgctgcacctgggcggctgattctggagccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382605 - DNA, 2540 bp, Homo sapiens
gctgagccttggccccggggctgttagaaggcagaggctctggggagaagtccccaaaccggatttacccgttcgtcgcacctgtccctaggagggcaggctggggtgtggaggcggtgccctgctgacccgcggggagagaagcccgggtctcccaggctgcaaaacgctcggcactgcggaagccgcgccaggctctcccagctcgatacgcagcggccggcgcgcctgctccgccgcggggccgagcggcagaggggcccggggctgcgtggaaggcccgggggcttcagcccgtgccggggaagccgacgctcagccaaccagaaagttagaggcggccgaggtctcgcggaggggaggcgcctggcggccacgggagaagtcgaagggctcaggcggggctccatccgcgacactgggagcccgggcgggcgcgcacgtgtgtatacgagtgcgtgggcccatccggcggcccggactacaagttccagggtgcccagcggcgctcccgggttttctggccgcgcctcccgctggctccgagcaggtcgccgctggctggcagtcgccacccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccggagcctgaaaaccttccatcgggtcgccagcgagtggccagtggcgggagagctgcgtgggagctttgagagccggctgcttctccctggcggttcctttgtgatggccttgaacagagcatgaggtgtccacagatgttgtacaggtagtatccttccagttcaggggggaaaaaaaaaaaacccaacccagccctgcctgcaatattatttttagtccttccctccccaactggcataacttggtataaattatgtcttcaacaatgtcgaattccccctcctgccttctattcttttaaaaaaaattgtcactgttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagcccgggtgggcgggcatcatgtgtaggagtagtctatgtcggggatgccgccgtcccggtagccccgcgtggtgccgtagccaatggtgtgtgtggccttgcagaggctgctgccgttggaggggaagatagtgtggaccacgtactcctctttggcgcggtacgggttgatgggcagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctgtcggctgtctctgccttggcacacacaggtgtctcatcagctacgtaggcattgctggtctccatggtgaccatgcagatgatgtaggtggacttgggctccagggctgtcagcaggtactctgtcttgtccccctgcaccaaggtctccgtgatggagcccacggctgggctgtggcccaggcgcagccaactgagccggaaagaggaggcggggagcgtggccttccacgtgatgcggatggagtctgccgtcagggccttcacgtggatggccagggtcttggcgccatcacccgtggccatggggtagtcaatgttggagtcggggaggcgcagccctggccttttggccttgagggtaaacagggaaccctggggcgtggtggcagaggcgtggttgctggccgtggtcttggcagccgcattggccacgccgccct

SEQ ID NO: 382606 - DNA, 1022 bp, Homo sapiens
tctgttgtgcttgtttgttctctcttctcttttatttgttttttttctttttcttttctttcgcttcgtggtgctctatgtgcctttttttctgtcgtctcgcctgttcctcgctttgttctcttttctcctcttattttctctgttcttctctttcttttttctttgtctctccgtctcgtgttttttctttttcttttttttttctttttttttcttttctttttttttttttttcgttctttatcttttcctcgctttttcttctctactctcttcttttgctttccttttgtcctgcgccgttccttgtggcgctttccctcttttctctcctccttgtgctcttttgttcttcttatttcctgttctctcgccgcttccctcctttcttgttctttccggccgcccccctctttgtgttgggtgttttgtttggtggtttttgttttttttgtgtgtgttgtgtgtttgtttttgttgttcttgttttggtgtggtggggtgttcgggtgtgttgggtgtttttttttttaaagttaaatctttctatttatttcaagaaagaacaaggcaagtggacttggacattttctatgaaaatagacaaacagaaaataggaccaagtagttaatcacattcatctcaacattgaagtttcaaggcacctacaagaaggaggccaaagggcggttcgcagtgcactttggtttgtgttgttgtcgtggtggtgggtgtttgcgtgtctcggttttctggaaacccttgcctggtggtgaggttgggagcgaagcaggtgggcacgaggccaggctggtctgggccctgagaagccgggccgggtcagccatctggtcgcatggcagcaggcggtagcggggacggtcaggcccgtcactcaggcccctgagacggcttccaagaaaaagaaaggagatagtgctgcacctgggcggctgattctggaggtgaggaaggctggggggcgtgggaagtgggggtactggcacaggggcccctt

SEQ ID NO: 382607 - DNA, 479 bp, Homo sapiens
tcccccactacttccccgtgggtacgtgccccgcgccgccccacggcccgcccctgccccggtccaccctgggggcgggctctcactgtcctctgccttccagcctgaggctcccgcagcccaccctgaccgggactggtaagcagggcctcgccccgtgcggcggccccggccctagactaacccgcccactaacccccgctcacccccaagcagggcgggaaaccacggggcagcctgggaggtcggggacgcccatagacacctctgactctgctctgccctcagacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctgagctctgactggggggaaggaaggcggcccaggtgttggatggagc

SEQ ID NO: 382608 - DNA, 1525 bp, Homo sapiens
ttgttttttttttttaatcgactacatgattgttcaaagaatgcagtgaaagatgccatgtttctgcaaatctgcaagggaaatggtatggaataagccaggggagagatttcaggaccatatctccagggcaaaagatcttttcttccctctctcctttgtgaggagcctgaaaaccttccatcgggtcgccagcgagtggccagtggcgggagagctgcgtgggagctttgagagccggctgcttctccctggcggttcctttgtgatggccttgaacagagcatgaggtgtccacagatgttgtacaggtagtatccttccagttcaggggggaaaaaaaaaaaacccaacccagccctgcctgcaatattatttttagtccttccctccccaactggcataacttggtataaattatgtcttcaacaatgtcgaattccccctcctgccttctattcttttaaaaaaaattgtcactgttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagcccgggtgggcgggcatcatgtgtaggagtagtctatgtcggggatgccgccgtcccggtagccccgcgtggtgccgtagccaatggtgtgtgtggccttgcagaggctgctgccgttggaggggaagatagtgtggaccacgtactcctctttggcgcggtacgggttgatgggcagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctgtcggctgtctctgccttggcacacacaggtgtctcatcagctacgtaggcattgctggtctccatggtgaccatgcagatgatgtaggtggacttgggctccagggctgtcagcaggtactctgtcttgtccccctgcaccaaggtctccgtgatggagcccacggctgggctgtggcccaggcgcagccaactgagccggaaagaggaggcggggagcgtggccttccacgtgatgcggatggagtctgccgtcagggccttcacgtggatggccagggtcttggcgccatcacccgtggccatggggtagtcaatgttggagtcggggaggcgcagccctggccttttggccttgagggtaaacagggaaccctggggcgtggtggcagaggcgtggttgctggccgtggtcttggcagccgcattggccacgccgccct

SEQ ID NO: 382609 - DNA, 1816 bp, Homo sapiens
gctgagccttggccccggggctgttagaaggcagaggctctggggagaagtccccaaaccggatttacccgttcgtcgcacctgtccctaggagggcaggctggggtgtggaggcggtgccctgctgacccgcggggagagaagcccgggtctcccaggctgcaaaacgctcggcactgcggaagccgcgccaggctctcccagctcgatacgcagcggccggcgcgcctgctccgccgcggggccgagcggcagaggggcccggggctgcgtggaaggcccgggggcttcagcccgtgccggggaagccgacgctcagccaaccagaaagttagaggcggccgaggtctcgcggaggggaggcgcctggcggccacgggagaagtcgaagggctcaggcggggctccatccgcgacactgggagcccgggcgggcgcgcacgtgtgtatacgagtgcgtgggcccatccggcggcccggactacaagttccagggtgcccagcggcgctcccgggttttctggccgcgcctcccgctggctccgagcaggtcgccgctggctggcagtcgccacccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382610 - DNA, 1246 bp, Homo sapiens
taagtaagctgggtgttaatcggcgaggggctgcagtcgcaccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382611 - DNA, 1407 bp, Homo sapiens
taagtaagctgggtgttaatcggcgaggggctgcagtcgcaccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggtgagtctggaagaaaggcaaggaccaggagtgggcggtggacccagacgccgggaggggccggggcggacaggggagtgggcggggccagagcctaggactcactcccgccccacccgcctcaggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382612 - DNA, 898 bp, Homo sapiens
gatgtggggagggggcgcggggctctgtgcgcgtgcggattcgggctcgagggggcccacaggggtgggggccttcgcggaggaggctcagcgcttggggggaaaggtgtttcctgcccccttctgcccaggccggcagggggaagcgagggagctgaggaccgcgtagacccccgccggtctgaccccgtcgccccccgtagacgtcatccacacagtggggcccatcgcctacggggagcccagcgccagtcaggctgccgagctccgcagctgctacctgagcagtctggacctgctgctggagcaccggctccgctcggtggtgagggacggcccgcgggggagggcgggaggcggggcgcagtgacaatgttccaaccccctctcacccctccccgcccaggcgttcccctgcatctccaccggcgtgtttggtgagtctggaagaaaggcaaggaccaggagtgggcggtggacccagacgccgggaggggccggggcggacaggggagtgggcggggccagagcctaggactcactcccgccccacccgcctcaggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggcaaactcctactgtctg

SEQ ID NO: 382613 - DNA, 1607 bp, Homo sapiens
gctgagccttggccccggggctgttagaaggcagaggctctggggagaagtccccaaaccggatttacccgttcgtcgcacctgtccctaggagggcaggctggggtgtggaggcggtgccctgctgacccgcggggagagaagcccgggtctcccaggctgcaaaacgctcggcactgcggaagccgcgccaggctctcccagctcgatacgcagcggccggcgcgcctgctccgccgcggggccgagcggcagaggggcccggggctgcgtggaaggcccgggggcttcagcccgtgccggggaagccgacgctcagccaaccagaaagttagaggcggccgaggtctcgcggaggggaggcgcctggcggccacgggagaagtcgaagggctcaggcggggctccatccgcgacactgggagcccgggcgggcgcgcacgtgtgtatacgagtgcgtgggcccatccggcggcccggactacaagttccagggtgcccagcggcgctcccgggttttctggccgcgcctcccgctggctccgagcaggtcgccgctggctggcagtcgccacccggtcccagagtaaataagggagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgactctcacagccaggaggacccggtacccgcctggaatcccagggaatgacggaggcagggtctgaacacgggcttcccacacagagcccgagtctcctttcagccgtccagggctttgtggaaccccagcgttcaaagtggctttggcactggtcaggcctccagggtcctgggtggccttggctcccaccccagcccctgtgcccaccagggggcagcagagattgcagttcccaggagcccatatatcagcctgtttattagtggaataaaagtcgttggcaacggcagggcttttcggggctgcataaatctgcgtctgtgcctcgtgaaacccatatgtgcttaattcatatgtaaagtttcaagcaggaagagaatacgtgtccattaaattctatttgacttgattataatcattagccg

SEQ ID NO: 382614 - DNA, 371 bp, Homo sapiens
aaataggtggtcaaaagtgtgtttcagcttttagggagtacctagcatttgtgtcaaatgaaacctctctgaagagaacatgaaggatgaccttgaccagtgaaacccaaagcataaacatcctgacagcagtcaatgtgtggtcacaacagaataacaaggacaggagaagaaaggccatctctgtggacactaattatttatttaaaggggaatactaatttgtgttttatcctgtagtcggcttccttttcttcctcccagagctgtggttcctgccagaggacacttccctcgttggctgtgcccaggagcagcttgaccagaagattttccctgttatgaagtcataacacatatcataatagtaa

SEQ ID NO: 382615 - DNA, 304 bp, Homo sapiens
cagctactcgggaggctgaggtgggagaatcgcttgaacctgggagacggaggttgcagagagccgagattgcgccatcacactccagcctgggcgacagagtgaaactccatctcaaaaaaaaaaaaaaagaaccaccactgtaactgagaaatagatgatcccattaacagtttagaaaatgtatataactctaatccacagaggtttatacttacaagcaactcatggtttccctttaagggacacatgtggaaaattaatctgaacagttagtgcaaggaggagtcatacctcagagaaa

SEQ ID NO: 382616 - DNA, 820 bp, Homo sapiens
ctgctgcactgcactttagcctgggcgacgagcaaaactccttccccaccacaaaaaaaaaaaaaaaaaaaaaaaaaaagaagagaaactactgaagccaaaaagcctccaaacttgaagatccctcttgctaaggaacaattacttgacttaggcatctagattgctctgtgtgtcttgagtatacatgaagagtataaacccccaccaaccatccaggatcattcagcaaccctctgtgtgaatttgagtttttttttttttttaatattgtaagttgtctgggtgtcctttctgaccttttcttctatgaagtcctgaatttctaacttgcttctaaattgctgaatgtcacattgtcctgttgtagctttctctgaaatgcacaggaaatgtctgtagggttggcaagctcctcctcccccgacttcactcctattccacacatgtactttcagcatttgagagcctgtcttctctcttagctcccttaaaaacatttgtagtatttccactttttatgaagttaaaatggtttattttcaatccactgagttagaaggatcatgtctatccttaacctttgccaaatatccttaaaaatcatttttttcttgggaaacttccataatgccattcttataaatgcatgccaagcctgagcctgtgggtggttttcttcatctgaacttacttttcaaatatagcagtatgagacttgaggtaggggaagcagcatcagaaatggaagggctggaaactagactcaggacattgtttaaaataatcagaataaatactttcatttatttaacattct

SEQ ID NO: 382617 - DNA, 299 bp, Homo sapiens
ttttataccaaaaggctgagggaaaactagagtaatatttttaggttttatggctggctttgaggaaagggagttctagtttctgtgacctagagaagagggattctagtttctatggcttaccttgggggagaatgggactgagagacagagcaggagaaggtcaaagaaaaacttctgtgtctaatgcagctgagtccttcattttggagtattgttttctgagcccaacaaactttttattcagctttgtgttctcagcagttagcataatgtatagcatatagtaatgtggtaaa

SEQ ID NO: 382618 - DNA, 419 bp, Homo sapiens
cagcaggaaagcaagaagagtagtagggcaatcgggaggttttagaaacagttcagatgaaagatgatggtggtagtagcagtgatggtggtggtggaaactagtcatgttttttatatattttgaagatcaagctgataggaattgctaatggatttaatataaggtatgagaggaagaaagacatcaagaatgatgccaaggcttgagaaactggaataataaaaatgccatttactggtgagaactatgagaggagtaggttttgggtgaagaacagaaatctggatttggacttagattggagatgcctaagaattttgctcagaacaatgtttgatatacaatcaacaccccatagaaggttagccattaggactaccacaaacattacctctttggtggttctgtggaggtta

SEQ ID NO: 382619 - DNA, 325 bp, Homo sapiens
  misc_feature (293)..(293): n is a, c, g, or t
  misc_feature (297)..(297): n is a, c, g, or t
tgcaaataaaaagtgtagtataactatttacatagcatttacattctattaggaattataagtaatctagagatcatttaaagtatacaggaggatgtgcataggttatatgcaaatactacaccattttatattagggacttgaacatcctcagattttggtgtctgagggagtcctggaagcaatcccccacagataccttgtttcagatgaaaaagcatcatactctatgggtaactggttaactcaccttattctgatatatgaatgccatttcacgaagctgaaaggntggntcctggggaaggttggagccagcttgca

SEQ ID NO: 382620 - DNA, 431 bp, Homo sapiens
tgcaaataaaaagtgtagtataactatttacatagcatttacattctattaggaattataagtaatctagagatcatttaaagtatacaggaggatgtgcataggttatatgcaaatactacaccattttatattagggacttgaacatcctcagattttggtgtctgagggagtcctggaagcaatcccccacagataccttgtttcagatgaaaaagcatcatactctatgggtaactggttaactcaccttattctgatatatgaatgccattcacattatgctggatatgggtcaaacttaagttcttctgcgaaagccacaacataccaggcatcagaaatgctagagagttttgaccatcattcagaaaaacaattgtttaacagcaaccaacaattcaaactatttaacaggcaccagctgtca

SEQ ID NO: 382621 - DNA, 787 bp, Homo sapiens
gagaagaagctcagggtttccttgtgaaaattctagggacacttcgctgcagcagagaatcgtccccattccgaacgcttcggcggcctagaccagaggcgcccttccctggagccggcgtgcgcgcttggggtccggagtggatggggctaaggctcagatgctagcgcgctcccagttcccccgctagccccatagtccagcggcagctgatattttcaagtttgacttcaatagaaagcgtcaagaccaccttccctagggcgagagcgaagtgtcccccggcccctggcgtccccgctctcctaaggactcctctcagttcaccaagcagatctccggttcggtgccagtccctaacacccaaggttgatcaccagcggtacaagaactgaggcaaagagatgcttttccttttcggagccgcgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggccggggggggggggggg

SEQ ID NO: 382622 - DNA, 437 bp, Homo sapiens
cataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcat

SEQ ID NO: 382623 - DNA, 1094 bp, Homo sapiens
  misc_feature (404)..(404): n is a, c, g, or t
  misc_feature (762)..(762): n is a, c, g, or t
ctgtaatcccagcactttcgggaggctgagatggggtcttgctttgtagctcaggctggtctcaaactcctggctttaagcgatactctcacctcagcctcccgaaagtgctgggattacaggtgtgagccactgtgctcagcttcttctctccttttataaaggatgaattatctgtgctcctagcaaagaccaaccccatccacttgtacatcagactctatctcctctcatctattcaaggacacttctccagcaatttcctccctcttttctgcatcattaatttctcttgtagattcttctcatcaacatgcaaacacatttgtcagatcacgtcactattctgctcaaaatcctccaaggttttttcattttaatcagagtaaaagcaaaagtccaantgctctggcgccccctacctctctgacctcatctccctctggcttgctcttgtcatgcctggcctccttgctgtttcttgaacactccttcataacctcagctcacagattttgcgcttgctgttctctctgcctcgaaagctcacctccagatgcccaggtagcctgtttcctctctctcttcaggtctttgctctactgtcacctcactgaagtcttctccgaccacctgcttaaaactgtaccccttcccacctttccttaccacctttccctgctttttatttcatagaacttgcatggtcattaacacactgtatgttttattatttggaaagctccacaacgaagggactcntgtttcttttgttcactgcagtatctctagcatatagaacagtacctaactatagcggatggttagtacgtgttagctgagtaagtgaatcaaataatcacgtgttgcaggtgaaaaaacaaaacaaaaccaaaaaaccaaaaatccaaattttaactgtaattatttctggctgattgaattctaaatgttttctgttttctcctttgtattttccaaatcctttttttttttttgagatggagtgttgctctgtcgcccaggctggagtgcagtagcgcgatctcggctcactgtacttcagcctgggcgacagagcgagactcagtctc

SEQ ID NO: 382624 - DNA, 319 bp, Homo sapiens
tggaaagatacgcaaaagtgttataagagaaggagaggataattctggctggtgggatgatctaggaaagcttccttaaggcagttttaaataattccagaacaagtcaaatgtattctcttatacccctactcagctcctatactcaattatataaaataaacatgaaaaaacctcaaataattatgaataattactatatgttaccaagtattttaggcatgttagaatgatattttacctcctctaaagcagggaccatagatggtttgctatatggtttagagaaattaatacatagtgattgtttttaaaatac

SEQ ID NO: 382625 - DNA, 600 bp, Homo sapiens
aaaacttgcacattcaaagcacatgatttgtacagtcacacctggcagtagcactgcacagttacaaatatgcacacacgttaactgctatgcataaatattgacagttaaaccagaacacaattgaaacagtgacataaatacctacaggattcagaattgttccagggtaatataaattattctacttgttcactctccccaccctcttgaacttgttagaagatttgctgctttagcagaatctttccaagattgagaaaagtgtatcaacctaggattttcattactatatagtcacataaatggaggaggagatatatttggcttctgcctctgcaacaattagtatgaacatatttctttctctagggaataataggttttaaacatttgagatatcatgaagcaaagtcagggtataccactacaatccccactaatctctattcccacattatgaaattgtacagaagaaagggtgtcattaaatcaaggtatccagataattcatggctactttaactattttttcattcgtgttaactgagccccccatattttttactacttaaccttaaatatgccatcactaattta

SEQ ID NO: 382626 - DNA, 591 bp, Homo sapiens
aagatgtttttcattgtgagcatgtagtttgtgaaataacagataatggaaaataatacaattgagttattttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtag

SEQ ID NO: 382627 - DNA, 383 bp, Homo sapiens
ataagttcttgtgtggatatgtttttatttctgttggatagatacctaggagttgaattgctgggacatatgatagttgtgtttcacatttttagaaactgacaaactattttccaaaatgactatgtcattttacttccttatcagcaatatagaaggttctagtttctccacattcttaccaacacatggtaccatctatctttgattacagtcattctagtgggtgtgaagtatgatttccctaatgactaatagtgttgagtatctttttatgtgcttattggccatttatcctcttaggagagaaataactgtataaatacttcgctcatttaaaaattacattttcttactaagttgtaagagttctttatatattt

SEQ ID NO: 382628 - DNA, 152 bp, Homo sapiens
atccacataggaaaaattttttacccggcgttacacacaaaaataaactcgaggtgaagtgcatatgtaaatacgaaagcaaaatattatactttgataagaaaatatataaatatatcttcctaacttaggctgttggaagagtttcataa

SEQ ID NO: 382629 - DNA, 295 bp, Homo sapiens
ctaattagaattgagataaaaagatggaagaaagccacttccacagcacgttttatatgaactcgcaggaagcagaagtatgcagaagttagaagaggcaccttgagctcaaaatgaaaaaattctgtcttttaaacatcactgcttgtcttcatcagaaaccaaatgtgacttcttggtagggatgttgtaaaggggtttaccattggtgggtagatgaattccatgaatttaaaattgcttttcacctttgaaatttagtgagttcattacagctgggaggcagacctatggg

SEQ ID NO: 382630 - DNA, 234 bp, Homo sapiens
catagcgccctatccttctgcatctgactttgaaaggcagttttactttcacacaactttttatttcaataaacctcttacagccaaaaattgtcttgggctccataactggaattaaatgatttctactcttgttgacaaaaagaattcctcaagagagtaactctaacattagcttattatgttgtcattgttgatgttgaatatttaagctctcagggtgcttttcttaaa

SEQ ID NO: 382631 - DNA, 507 bp, Homo sapiens
ctcaagtagttctttatagcagtgtaagaacagacaatacatctagcttacatggagaaaagaaataaattttagctggttagctgtgtcctcagccaaaaattgggattcttaatactaaggaaggaagaatgagtatcaggaggcaaaattatttcaaggatcagtttggtttcaaccaagtaaagtataaagaaagacagtggatgggttatggtcaccacaaacatatactctgtttttcagcatgacatacaaatacagagttaactgttcaggatgccagagaactttagttgtgttatattcacagttttcaaagagaatggcatcaataagaacactgacctggtttaaacatggaaatccactaataactttaagcaagtttgaggcagcagcatgaaatatattctttcacagaagtttatgtgtggcatttctttagagaaagcatccatttctgaatcagtcaggattcagttctagcaataagaatcatcaccc

SEQ ID NO: 382632 - DNA, 426 bp, Homo sapiens
gagaaaaccaaataaatgagggtcaactctatatttctataaactagcaataaggaaaaaatagttatatatatttatatactattttcaaatggcatcacaaatatcaaatataggagtaaatctaataattttataggcaaaatggagaactcagtacaatacagatgtcagtttttcccactctgatctatagattcaaagtaatctcaattaaaaccacaatagagggctgggcacagtggcttacacttgtaaacccagtactttggaaggccaaggcgggcagatcaccttgactgaggacaggagttcaagaccaccagcctggccaacatggtgaaatgccatctctactaaaaatacaaaaaacagccaggcgtggtggtgggtgcctgtaatcccagctactctgggggctgaggc

SEQ ID NO: 382633 - DNA, 452 bp, Homo sapiens
aaggggtttgcccaacgagacttctctgaagccccaaagtttacccagcctctggccgactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatggtactctgacaaagtgcctccaggaagcccgccagtggtgagactgtgtcctcaaggagcttcggcaccatgtctggtttggattcatctaaataaatatgtggttccccagtgc

SEQ ID NO: 382634 - DNA, 353 bp, Homo sapiens
aggtaagttttcaagaattactaactctaaaaccctactctcacctactttaatttttttccccttttggttcattttatttgaaaacatgcagggatgtggttagtagaggatttgtactttaaaaaaatattcacagttggaaaatgttaaatatttcaggtgctggttatgttaactagcttgattttattattccacattacattcatatatcataacatcaatttgtactccaaatttatataattacaaactgtcaatttacaataaaaaagaatcacagttggaagtaaatagtatgctgtgctgcaaaatagcaatgtccttttttttttttttttttttttttt

SEQ ID NO: 382635 - DNA, 516 bp, Homo sapiens
gaccaagacaatcgaacatccctggatatctgagatagccagcctttcttctggagagcttcccagatgaagtcttgctctgtcgcccagactagattgcagtgatgtgttctcggctcactgcaacctccgctacctgggtttaagcgactctcctgcctcagcttccagagtagctgggactacagatagaggcattcggtactcctcaacttctgttcctgatggctcctcccgggaaatttcacctaaactcaacctcatgagctacagaagaaatggtcctttaatttagtgccttccaatttagaaagtgagagtggctgtacatccaaagagttcatggcagtcgcccggcacctacatgctgggtccggagaaagggtcgcgccgggcagccgcgaaagcaaggcttccccacgtctgttgacaggacggccgcctctctacttccgctggctacggcctctacgcagtagaggtaccgcgtctgtgggtcgggtttccggggccgga

SEQ ID NO: 382636 - DNA, 967 bp, Homo sapiens
agttgcccattaccatggatattttggaagtgattatgtactgaatcttaccatgaagcagtagtccatgtatctgaattacatttaggccttttaaaacatatcacattatgtatatagttagaaggagggatgagatgggtatttttgaattgagtttaatggcttacttcaataggtgaataaggttctgctctgggaattaaagggacttttaagtttctctcttgactctgatgtgcctttcactgaacagtaaaggaccggggagacttgcccagctctcctacttgacaaaaggtgaaatagaatgatgccatgaaatgcatcaatgtaaaatgcagttttaagattgcattttaacttgagagggtcgtgaagctcttgccttcccattaagcccccaggaataatctccaggtgtgtcttctggcactccacgctgcctgccttctgatgcttcctatgaattgttggaaccagccatatccttctcacttctgccacaaaaactcctggtggttttgtactttgccaccttgtttaggtttcataggcgattggttcaaggcagtgcctatctgcacttccctgtaactctcactttttttctttaatgtggcctgcatatgaatatatcaacactttttaaattaaaggctaatgagctcactgcacagcctgagtacgtttggtatttggccttcttggagatgctctgcatgtgtcaaatgttattttcagaaaactggctaaacttttaatgggacctgttgttaaatcaccctgtgtttcccccataaacacgaatgttaatttacatttttaacctaactgaatgagttgtttttcttaaattcctttgcagtttgaaggaacataccttgcaacaggaaagctttaagaaagaggacgaaaaggctttataatctttcttgaagagaccctgttgctaaaaagaaaaaaa

SEQ ID NO: 382637 - DNA, 913 bp, Homo sapiens
agttgcccattaccatggatattttggaagtgattatgtactgaatcttaccatgaagcagtagtccatgtatctgaattacatttaggccttttaaaacatatcacattatgtatatagttagaaggagggatgagatgggtatttttgaattgagtttaatggcttacttcaataggtgaataaggttctgctctgggaattaaagggacttttaagtttctctcttgactctgatgtgcctttcactgaacagtaaaggaccggggagacttgcccagctctcctacttgacaaaaggtgaaatagaatgatgccatgaaatgcatcaatgtaaaatgcagttttaagattgcattttaacttgagagggtcgtgaagctcttgccttcccattaagcccccaggaataatctccaggtgtgtcttctggcactccacgctgcctgccttctgatgcttcctatgaattgttggaaccagccatatccttctcacttctgccacaggttcaaggcagtgcctatctgcacttccctgtaactctcactttttttctttaatgtggcctgcatatgaatatatcaacactttttaaattaaaggctaatgagctcactgcacagcctgagtacgtttggtatttggccttcttggagatgctctgcatgtgtcaaatgttattttcagaaaactggctaaacttttaatgggacctgttgttaaatcaccctgtgtttcccccataaacacgaatgttaatttacatttttaacctaactgaatgagttgtttttcttaaattcctttgcagtttgaaggaacataccttgcaacaggaaagctttaagaaagaggacgaaaaggctttataatctttcttgaagagaccctgttgctaaaaagaaaaaaa

SEQ ID NO: 382638 - DNA, 447 bp, Homo sapiens
cctccttgttgatttcaaaacctatttagattggtgcaaaagtaattgcggtttttgcctttaaaagtaatggcagcagaataggttggaaaatttacccctctttccactgtaagatgatgtggtggttttccaaaacaaaagattgataatctgccagcatatgtgtttaacccaatttataatatattcagaatgttttttcatttctctaaatgtttttcacttgtttttatgtgaaaccctcaaaatggggaagttgagagggggatatctcaaatttttgtgttttatgtgagttttaacagttcacacttactaactagaaacatatacattcattcagcaatccaaagaggtcacagtttgggtttctatgaagaacatatgctcaagtaagaatataagattttactaaccacagctcctgttaaagaggattttgaa

SEQ ID NO: 382639 - DNA, 671 bp, Homo sapiens
ccctggtgtagacccacgctccttactgcatagatttatcttcagattcaacaagttttttaaagcctacattgaatgtatttaaatatctgagaattatgttaaaaccgtcactattttttctagtttgactttttaaatgacagagaagagcatgagcctgggaggacatcccaacacccggatcccttcggggacattggaaagttttgttggggtctcacgctggcggcgtggtggctgctgactggcgggtgtgtggtgcacttgctgtggctctgaagttccagaacctgttgtcaggaagaagcactggtttcttcttaatggtctccaacatcttttccagggatacttcaggccagggaagattttgtaccatattccgctcctactcccggggcgcacaggtaacacagcatcccccgagctgggagatcaaaccaactttgaataataacatttacaatgcttaacttaccatcctttaatggatgattggaggacaaggcggttaagcttacgtataaattggtgctgagagtctaaaaacgtgctgtagagtggttggttgtttgaaagacttcatcagtattacggatgtaagcgtgcatttacgggactgtgtgtgcatgtacacgtgtgtgcaggtacgtgcactgtgtatgcgt

SEQ ID NO: 382640 - DNA, 640 bp, Homo sapiens
cgtctgcaaagacggtctttccaattacgaggtcccatgctgaggttctgggtggacatgaactcgtggggggttcctcgacccagagcacccacattacgacgacaacaaaatctcactgaagtaacccatgctcctcgcctttctcctgcccgctagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaagggtaggcccaggggctattccgggggccacctctgccctccagatgccgaggtgggtcagcggccccctggataagtgtctgcctcccgggacccgtctcaaggccactgtgtccgttctcagagcaaggcatttgagagaagtaatgactacagctttgtcagaaagctcatgagggagctcctgggatctgtacgtgggcagaggggacgtcgcggcagggcttgctgcatgtacaagccagggccacgggcgtccg

SEQ ID NO: 382641 - DNA, 647 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcggatagttcggatgtcgctgtggcaaagtccgagggccagcgctgccctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctttgtctgcactgtgccctcggggtctgggctcagtgagggatgaaccctaccagagctacaggaataaagcacccaacaacgtgtacgcccagacgaatatg

SEQ ID NO: 382642 - DNA, 534 bp, Homo sapiens
cacccagcggccacagccccgcggcaaacccaccggcctccaggtcacatgtaggccctgcagtgcctgtcggggagccccctgggccagggtgatgcgagcctgacccccacagaggccaaggcggctgaggacaggaggggcccgggtgcgggagggcgcaggcagggcccctgtgagcttgggcagacacagggagggggtcccatccgcctgccttgtaaacctggaagttgcactgatgagaaacccttttcttccctgaacgtgagacttccagcgtcctgttagctgcagcctcaggcctaagccgtctctaacccttccgcaggcatcgactacaagacgaccaccatcctgctggacgggcggcgggtgaagctgcagctctggtgagtctggaggaggtgcgagcgtcccgcacccccagggagtaacccccctggctggcatagcaccccctgtcagcacagtgccccggggagcacccatcccccaccaccatcggcacagcgcccccgggaacaccctccc

SEQ ID NO: 382643 - DNA, 516 bp, Homo sapiens
ctagaggatccccgctgactcttccccggatcccttcggggacattggaaagttttgttggggtctcacgctggcggcgtggtggctgctgactggcgggtgtgtggtgcacttgctgtggctctgaagttccagaacctgttgtcaggaagaagcactggtttcttcttaatggtctccaacatcttttccagggatacttcaggccagggaagattttgtaccatattccgctcctactcccggggcgcacaggtaacacagcatcccccgagctgggagatcaaaccaactttgaataataacatttacaatgcttaacttaccatcctttaatggatgattggaggacaaggcggttaagcttacgtataaattggtgctgagagtctaaaaacgtgctgtagagtggttggttgtttgaaagacttcatcagtattacggatgtaagcgtgcatttacgggactgtgtgtgcatgtacacgtgtgtgcaggtacgtgcactgtgtatgcgt

SEQ ID NO: 382644 - DNA, 1850 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382645 - DNA, 1907 bp, Homo sapiens
cacccagcggccacagccccgcggcaaacccaccggcctccaggtcacatgtaggccctgcagtgcctgtcggggagccccctgggccagggtgatgcgagcctgacccccacagaggccaaggcggctgaggacaggaggggcccgggtgcgggagggcgcaggcagggcccctgtgagcttgggcagacacagggagggggtcccatccgcctgccttgtaaacctggaagttgcactgatgagaaacccttttcttccctgaacgtgagacttccagcgtcctgttagctgcagcctcaggcctaagccgtctctaacccttccgcaggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382646 - DNA, 1699 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382647 - DNA, 1187 bp, Homo sapiens
catgctgatgtcagatctagaggatcccggaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382648 - DNA, 1627 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382649 - DNA, 1535 bp, Homo sapiens
cgtctgcaaagacggtctttccaattacgaggtcccatgctgaggttctgggtggacatgaactcgtggggggttcctcgacccagagcacccacattacgacgacaacaaaatctcactgaagtaacccatgctcctcgcctttctcctgcccgctagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcaccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaatgaagtgaaaacacttatttaggaaaatgtttctcaacaataaaatgtatagttgtttctcttcccttagcttcataacttgtagaatatcttgtacaaaaaactgtagatttacagaaaaatatgcatataaatcacttattaatcgtcgacg

SEQ ID NO: 382650 - DNA, 1400 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattgaatggaattagatttaattcccaagggaattaggacaaaaccatggcaaggggagataaattttaaaagcaccctaatttttcccaagaggggttc

SEQ ID NO: 382651 - DNA, 1273 bp, Homo sapiens
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtacctgaatctgatggtcttatataatggcggagatttccttcgggttgtgggggg

SEQ ID NO: 382652 - DNA, 471 bp, Homo sapiens
  misc_feature (460)..(460): n is a, c, g, or t
ttgataggatgattaaagttaggacacgtaggttaaggtggtttttcttccttgtagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcagtaagttgccctcttatttgtattcagcatgatgcacctcacagtctgatgaaatcagctactcccctggaaagttagaatactgttctttaacagtaacaacataattacatgttgtaatccttatctctttcagttggagagcaattatggacaatctgatgacacatgataaaacaacatttagagatttgatgagtgagtattacgggatgacaatccaagttctttcctgtacatgcctatcaaaagncgagggtaccg

SEQ ID NO: 382653 - DNA, 639 bp, Homo sapiens
taattcattctgcttttttaatgttaggaatgattacatgaaatatcttcttactatcatattccattttgcgtttaactgacctgtgaacagaagttatgatttgagtttttataacttcttactcaagaaccagactcttcatcctcctttataagataattccattttattcaccaaactcagcctccatttgtaatctatgactagcattataaggtcaggctattgagtgtatttaaactggttgtgacctagagcaagcactgcctaaaatctgaacttatatacagagaggtgttagggttaaggtcagactgaaacaaagatagtcttcattatttttacaggttaaagactaatgttcagttgacagccctccataatatgaggtagagacgtacaaggtgaaggaaaaagaactaagagggaaatggagagaccaggctagggagtacatgactgtggtatcagtagttaaactgagaattactgcagttgtattttacttttgagatcccatgtgataaatgggatttcaatagaaaaatttctagattaagaaattgcaggctaggggcggtgactctcgcctgtaatctcagcactttgggaggccgaggcgggcggatcacgaac

SEQ ID NO: 382654 - DNA, 6500 bp, Homo sapiens
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccatttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatatagtaacaaattccaaagcccttaaataaacggaaaacagaccaaattcttctaaataagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgaag

SEQ ID NO: 382655 - DNA, 2942 bp, Homo sapiens
ggtcgtggacccgccacagacactcaggcctccgtgctggccggcccccctaggtggtgatgcccatggcatgatgcctgaggccaatgtggatctgatcccccagtatttccttcccttggatgctttcgtgctcccgtctgtccctctgtgccgctgagtacgatgctcttgctgtcaggcatctgggcactgtagagagtgtcgatcgcgcagcaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttt

SEQ ID NO: 382656 - DNA, 3065 bp, Homo sapiens
ttgataggatgattaaagttaggacacgtaggttaaggtggtttttcttccttgtagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcagtaagttgccctcttatttgtattcagcatgatgcacctcacagtctgatgaaatcagctactcccctggaaagttagaatactgttctttaacagtaacaacataattacatgttgtaatccttatctctttcagttggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccatttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatatagtaacaaattccaaagcccttaaataaacggaaaacagaccaaattcttctaaataagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgaag

SEQ ID NO: 382657 - DNA, 1249 bp, Homo sapiens
gaaagacatagcatgtgtctaacatgggcaagaccatgttacttggaactctggggaagagaggggtgattcttgattttgtttcactaacaaattctaatgaaaaccttttttcatctttcagtaacaaattccaaagcccttaaataaacggaaaacagaccaaattcttctaaataagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgaag

SEQ ID NO: 382658 - DNA, 4585 bp, Homo sapiens
  misc_feature (4435)..(4435): n is a, c, g, or t
  misc_feature (4534)..(4534): n is a, c, g, or t
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctcctcgtgccgaattcggcacgaggagaactagtctccagtttttttttttttttttttgcattaagtggctttattgatgtttcacattcagttattatcaattcttcagttaattgtacaagtatgataaattattttctatttgctgngggaatttaaatgtaaaataaatactacatgtgtggtttaatgaacactcaatgaagcatctcttctgaggtattcctttcaagctggttttaacccanactttttacttccctaggaatagtctattccacacaatggaactgtcttgt

SEQ ID NO: 382659 - DNA, 488 bp, Homo sapiens
ttaattttagatttttctaattttaagtagtctaggttttctaacaaactgaaaatcagtaccttgggatgatgtcagtttcacctcatatgttactcttcattttttatgttttcataggttttggctcatcttttggatatggttttctatagtgatgaaaaggagcgggttattcctttacttgtaaatattatgcattatgttgtgccctacctcagaaatcacaggtactatcattatttaaatagtttttaaaattaattcatagcctgttagaaacaagttctgttcccttattgccatttctagaattatcataaaatggcatttttaccttgaattataattgtttaaaaaaattcatatattatttttcttatggtgctttctatttcatatcttcatgtcactgtcttaggtaaatgtgaacatttatgtataacttgataggatgattaaagttaggacacgtaggttaaggtggt

SEQ ID NO: 382660 - DNA, 651 bp, Homo sapiens
ctgcctttctttggtatgcccatttatactgtttgaatttttcccatggtcggatattacttttacttacttatgaaagacaaaattacaaacaaaaatacaagagaagtgcaaaaaaagcccttagttttcttaaattcgttcaattttttactcctttactatgcaactagggaacatttggccagttatatgttgaaaaatcaagtctttgtcagactgttatgttgcagtacaaagagataagctaaatgaaaacatcttccttttaagaaccttatgcctgttcgctaatgagaaaagaaacatttgttgagtacttgctttggactcatgaaaaaagtaatgatgagtactttacaagttttcatatttattccttacaaccttatgaggtagttaatagtatctttatttactgatgaaggctcagagaggttaagaaacatacccaaagtgacaaggctacgagtggcacatctggcatttgaatttttataagcagtggggtcatgatctttctactacattatgtggcctaatcttagatggcacaaagtctgtcttactgatgctgatgtcattattctatacataggtaccgatgggcctttattccagaagcctcagatgattcaggtttggaagtca

SEQ ID NO: 382661 - DNA, 516 bp, Homo sapiens
ttttgttctttcaatttttttaattaaaaattggcagtaagatacagagtagttgcaacaatgaaaaagcaaaggcagtattcttcttcactacaaaattgatttcttttatttatagaaacatctttctttggaagtctgcatgcttcagtttttctatgcttatattcaaaggtaagattactgatattgatctgtccttactatgttgctagaaacagagaaacattatttatggatatattaatataagtaatgagtgtcttaacgacccagccatgtatatcctacaaacctaaagacctaaggatattgaagattcctagatagtaaaacactgaattgtgataaaatcatttaaacataaatgaaaagttgaacctactctcgaaactatgcatattgccactgaatccattattttggtataggtgaacatacagtaattcattctgcttttttaatgttaggaatgattacatgaaatatcttcttactatcatattccattttgcg

SEQ ID NO: 382662 - DNA, 5089 bp, Homo sapiens
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttt

SEQ ID NO: 382663 - DNA, 4984 bp, Homo sapiens
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttt

SEQ ID NO: 382664 - DNA, 5830 bp, Homo sapiens
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccatttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatatagtaacaaattccaaagcccttaaataaacggaaaacagaccaaattcttctaaataagaactatcccagcttacttgtgagtctgcttctgcatatactcggacgacatcttctgtaccagagggccggacaaaagctcgagaaagcttgtacttcttcaccaggtcattgattgcctcctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgaag

SEQ ID NO: 382665 - DNA, 4912 bp, Homo sapiens
tatagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcagtaagttgccctcttatttgtattcagcatgatgcacctcacagtctgatgaaatcagctactcccctggaaagttagaatactgttctttaacagtaacaacataattacatgttgtaatccttatctctttcagttggagagcaattatggacaatctgatgacacatgataaaacaacatttagagatttgatgagtgagtattacgggatgacaatccaagttctttcctgtacatggttccttcttactatttacttgtactcttttctggagactaggagactactgaattagctctttgtcaagtgtcagtggggatatgtgctctagggaaagcacactactttctgtacgctatgggaatataatcttaaaatttacagaggacaacttaagtgataagtaataagtaaaactatttgtccttttgcagcaactagtggagggaagggtccatgtctaatttgaatctaaattatttcctcagtacacagcatcatacccagcacataataatagcactcaataaataattattcagtgaatgagagactgacagatggtgaagtgcaaaaggcaggcagtcgaatccagcctatcagacaagtcactttaaatctctggggctctgtttatttcatctgaaggaagaaagaggggtgccaagaagggcagaatcaccccccaccccctctttctactcttgattgtttttatagtttaggattccatttagaatttcatctgaaaaaaaagagttttaaaaaacgtttgaaagttattaaatagcagtaacattgtatgattctgtaatattttttaacaaattctttagctaaagctacagttttctcatttggaaaaagggcaggatatctgttttatcttcataaggttgttttaaggttcagatttatccattcaacaaatttttattaaaagacaacagtgggccacgcattgcgctaaccttaatcaaattttaaaagttgtgaaggaaatagggcaatgtgtgatggattttaaataacagctaaatagctcatatacaaggtgaaactaaagaagccaaccatgagaaggcctagggtcaaaatattccaggaatagggaacaagaattacaaaggttggctgggtgcagtggctcacgcctgtaatcctagcactttgacaggccaaggcactaggattgtttgaggccaggagtttgagactaacctggacaaaatagc

SEQ ID NO: 382666 - DNA, 234 bp, Homo sapiens
actacgtgaaagccaaataacactagatttgaaaataaattcctgaaaaaaatgtgaaacattaaaattcatatgagaatcagaaaatcgacacaaaccaacagctattaaagaaattgaagtgttactcaaagtcctctccagaaaaaagatctaggcctaaatggtcacataggggaggtcttccaaactttcaaggaacagataatcccagtctaaaatgatcctgaaaaa

SEQ ID NO: 382667 - DNA, 549 bp, Homo sapiens
agtaatctatagataatttatacaggaggatatatgtgggttatgtgcaaatactatatcattttatattagagacctgagaggattttggtactggtcgtggtcctagagccaatccccctcggatactgaggtatgcctgtatttatctgatatgtttagcttttagtgtctgccttccctagtagaagctgggatttttgtctgttttgttcaactgatgtatcccaagtccctagaataaatgaaaaatttaaaaattccctgagattaaaaaaaactaaagcaacaaaaaatgaccaattttttttattttaaattttctcttggtttctgtttcagttaaccataagatctttatctacatcataccataagcattttgattttccagttactgtgagtacagtgatgaccatttacttgacttttaatgcagttttttgaccaatgatacgctacaatcctatttcactgaatgagaataacatgatagagtagaggaaggttacataaagactattaattctaaaaatttcctagaacaaa

SEQ ID NO: 382668 - DNA, 1085 bp, Homo sapiens
aataggggtggggagtggtatgtacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgcaaaaaaaa

SEQ ID NO: 382669 - DNA, 654 bp, Homo sapiens
  misc_feature (65)..(65): n is a, c, g, or t
attcttgaaaagtccctgttctcggatctccaaaagtaaggcaaaattgagcatctaagagggantgggcctcaaagtggtgtgttggatgctactttttagaacccaaatgttcttattctggggaactccacatgtagcccaaagagggggataagcctcaacgacagagcagtccttatctcaaacattactgctggaactgtggaacccctgctatgagcagggtgctatgcataaatgttttcttcacccaggactggaaaacacccctacctgtggaaggagaatctctgtgtcctttcctcactttggggcaggatcactacacctcaacaggctagtcagtcattggatcccatccccttccccccacttccttgcttctttgcagttgggtggtaggagggccctcgtgccgaattcggcacgagagagaactagtctcgagttttttttttttttttttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgcaaaaaaaa

SEQ ID NO: 382670 - DNA, 769 bp, Homo sapiens
gtgacccccagtgcccacccagggttcacggctgcctacgaagccttggccaaaaggaggataaagctcatgccagcagggcggcaggcagcccccggtggtgtctcagttacagggtgacctctgtccaggctaccttctctgagaccccagccttgggggttctggggaagcggcgggcgggtggggggggggcggctcaggaggaagggatttgatgccaaggcgctctgctaagctggcacacctcccttcctcctcacttcctaagagagctggctggcaggagtcccctggggagactgggaccacactccacagatgaaaggaggaagaagaaagtttccctccgggggaggccaggccaggttagacccagaacatcctgatggactatttaggtgtgaaaagcagaggctcaggggctgacctgggaggagaagctgcaggaaacccagcaagaaatgcccagagtctgtctaccagaattccaccatctgaagtccccggggtgcaaatcctgtttgctgttaattcttccagctctcacgtatggtggcttgttgtgtcacgtgttttgcaattttgcattgcgcgttccatctttgtcagagctttatccgtgggaatcggtgtgtctaggctgggagtccgtctctccctggggggtgagcttatacttccacgaggcaccagaagacactccaaacccaagactgcttgaagtttagttcccatcttgcatgtagaataaattcagatccaaaat

SEQ ID NO: 382671 - DNA, 401 bp, Homo sapiens
tctgttttgttttacattctgtcagaacgtagtaggtaaaacatgggtgttagagtgagggagagaggttaagcctatcatgaaatcactggtcaagaacataactcagtaaaatgtttaatgatctttattagaaggcctttgtgtataagcaggtttgagattaattttaaaaaaacagatttccttttaaaatttttgataggcatttttaaatttaagttaatgctaaaatgtatttgttaatcttaagcctcatagttcccttaaagaggcttgagtaaagaagtattttaggttctgggcttaaatatggaaaatggattttaaggcataccccaatgggctaaccaaatataacaattatcattcccagtgcagtgctgtcttcaaactttctc

SEQ ID NO: 382672 - DNA, 350 bp, Homo sapiens
aaaatcccttcgtcccctcccttcttaggaatcaatggagtttacaatctgttccgatttcccccaggtgtcaaagggaggggagtgtttccagcctgctgcgtgtcccctgtggtggggacaggccctggcgtggggtccatggggagctgcagtggtcctgggcctgtacacactggccagcagaaatcacctttttcccacgcccctcccagaaggtttgaggaacagcaacgagactggggctggaacagagactgagtgaaggccagagccatgggaaaaaaggcgggggaagtatggggggctcaggccaggacagccactggagggcgtgggcagaagaatgc

SEQ ID NO: 382673 - DNA, 449 bp, Homo sapiens
tcattcttccaccaacccctaaggtgttaacctggtttgcatgaccaaaaagctgtcatggacatgtctgtttttcagagagagaagaggaaagaggtgaatccaggacaagcaacttcattttagcaagtgaggcagaagttgcacccattacttctgttacattgcaatgatgataacttagtcatgtggtttcttttcatgggaggaggctgggaaatataatttgaagcttgacagtcacatgtccaacaagaagggaaaataattttgtggggacaactagtcatctgccatactgaccaagaaaatgcactctttgaccgcttctgactccctttcactgttgcctttcagtgatatatcccacacggcccctttctgctgtggtccctcatcctgcaggcagctctcttgggcaatatccttcgaagaccattctagctgat

SEQ ID NO: 382674 - DNA, 344 bp, Homo sapiens
cccattttctccaaaccacccatccgtgctcagctgctctcctgtaaaggacacgatgaggtgagcagtgatgcctcattcgggagtccccatccagctgagcaccatcttccctcaggaccacttccttgaaggccacaagggagagggtgggactggcccacgaggaggcacctccaggccatcttccggcctaggcccacggctgtgctctcctgcctccgtccctcgcttggagggagcctcctctgacttgactatggaggagggtgaacaggcttagaaacccactgtgggtcactaatcactgctatgcttcatgcctcagctgtgcaaacagtgac

SEQ ID NO: 382675 - DNA, 362 bp, Homo sapiens
aagaaatcatctgaaggtacaaaactcactgttaatagtaagtacaggccaggcatggtgtaatctcagcattgtgggaggccaagaaaggaggatcacttgagctcaggagtttgagacaagcctgggagacatgaggaaacccatttctacaaaaaatatctctacataaaacacaaaatccatcttactaaaaatacaaaacccatctctaaaaaaaaacacaaaaattagccaggtgtggtggttcacgctacttgggatgctgaggtgggaggattgcttgtgcctgggaggcggaggttgtagtgagccaaaattgagccactccactccagcctggaagagtgagaccctatctc

SEQ ID NO: 382676 - DNA, 372 bp, Homo sapiens
tttttttagacggagtcttgccctgtctcccaggctggagtgcaatggcatgacctcggctcactgcaacctccacctcccgggttcaagcaattctcctgcctcagcctcccgagtagctgggattacaggtatgagccaccacgcccaaccacacatttttttcttttacaaaactaattagttcgctctttttggtactgacccagtttagattggtcctaagtcatatggtaacaggtacattgtgatttatacacacactatcttttagtatttaggcatttagaaagtttgtttaaaattttataaatttgccctccattttgtttacatctccccaaaatcctaaccaacttaaggggtaataat

SEQ ID NO: 382677 - DNA, 4062 bp, Homo sapiens
attcaataagctctctgttgattttttgagcccagtatgcgatttacattgtcagtcgtctgatcttgctgcactttctattacaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaagaa

SEQ ID NO: 382678 - DNA, 1136 bp, Homo sapiens
tgaaatgatgtagcttgattctcagtttcagtttaattgaaaatgccatgtcttttttctctttatagaaagcatcatcattcaccagttacgaatgaactccagatgaaatggtaaaccaagcacatactgggtgtgtgtacgacctctgaatccctattgaatggacagccctcaatcatgactaaggtcctccatgctactgatcactactggaaatattttactacttccagtgatttttttttaaggatataatgtaaaaagctgaaaatggccttgctgataatatgaaaatatgtagcaagagcaattcaatctatgtgccaaaagaaatttctttttgcaaagctttcaggtctatgggcacatgctgtataacttatattttataatacattttgtaatgtgattttttttgctaaagtgtttccctttttcatagtctctggcacatatatctatggaatacgctgtcagttcttcaaagtactggtattgttgcattcaaaatggtaatctataattattttctttttatcaatttgttaattctgaaaaaaagaaagtacaactatatttcctgaggtaaattcaagaggtaaaacttagaagcaggagactctggaagaggttttactattgcttgtacaatgctatggttctgatcatggttcaatgctaacaaataatgctctgacttaaaagcttaattttaaatactaaaaatcagtttctaaagttgctctttctggtgttctgggccaaaaaccttggatgaaatgatttttatatagaacaaattcataaaaggagatgtaccagtttaaccagtaagggcaataagaacagcttcgactgacagttcaattatacttctgattgcattatttacttgtatgtataagacttataataaggactgtgaaataaagatagttctcacaatctaatccaatcaaaacttgaatataaaaacagacctaaaatgtcaggatcttttttaaaaaataagactgggcatggtgggtcgtgcctgtaatcccagcactttgggaggccaaggcgggagaatcgcttaagcccaggagttcaggatcagcctgggcaacacagtgagagtcttaaaaaaaaaa

SEQ ID NO: 382679 - DNA, 4042 bp, Homo sapiens
gcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaagaa

SEQ ID NO: 382680 - DNA, 4371 bp, Homo sapiens
attcaataagctctctgttgattttttgagcccagtatgcgatttacattgtcagtcgtctgatcttgctgcactttctattacaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaagaaagcatcatcattcaccagttacgaatgaactccagatgaaatggtaaaccaagcacatactgggtgtgtgtacgacctctgaatccctattgaatggacagccctcaatcatgactaaggtcctccatgctactgatcactactggaaatattttactacttccagtgatttttttttaaggatataatgtaaaaagctgaaaatggccttgctgataatatgaaaatatgtagcaagagcaattcaatctatgtgccaaaagaaatttctttttgcaaagctttcaggtctatgggcacatgctgtataacttatattttataatacattttgtaatgtgattttttttgctaaagtgtttccctttttcatagtctctggcacatatatctatggaatacgctgtcagttcttcaaagtactggtattgttgcattcaaaatggtaatctataattattttctttttatcaatttgttaattctgaaaaaaagaaagtacaactatatttcctgaggtaaattcaagaggtaaaacttagaagcaggagactctggaagaggttttactattgcttgtacaatgctatggttctgatcatggttcaatgctaacaaataatgctctgacttaaaagcttaattttaaatactaaaaatcagtttctaaagttgctctttctggtgttctgggccaaaaaccttggatgaaatgatttttatatagaacaaattcataaaaggagatgtaccagtttaaccagtaagggcaataagaacagcttcgactgacagttcaattatacttctgattgcattatttacttgtatgtataagacttataataaggactgtgaaataaagatagttctcacaatctaatccaatcaaaacttgaatataaaaacagacctaaaatgtcaggatcttttttaaaaaataagactgggcatggtgggtcgtgcctgtaatcccagcactttgggaggccaaggcgggagaatcgcttaagcccaggagttcaggatcagcctgggcaacacagtgagagtcttaaaaaaaaaa

SEQ ID NO: 382681 - DNA, 3772 bp, Homo sapiens
cattgttctgatgacagggctggaatgtgacggttaattccctgtggagtagggggctgagcaaggcctgctgctgttgaacaaacttcagtacccccttataaaaaaacaaaaacaaaaacaaagctactatgcttcctagtattaaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaagaa

SEQ ID NO: 382682 - DNA, 1710 bp, Homo sapiens
attcaataagctctctgttgattttttgagcccagtatgcgatttacattgtcagtcgtctgatcttgctgcactttctattacaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaagaa

SEQ ID NO: 382683 - DNA, 392 bp, Homo sapiens
caccactgcactccagcctgggtgacagagtgagatcctgtctcaaaaaaaaaaaaaaaaagaaatgtacaggcacatttttaacagtcatggtagcaaatgcttgccagccttctccactcaacgcatacacaaaccactgactccttgatgtctacatctgtgaaaaaatatccaatgtcccccaagttgtccttagagtctgggtttcatagcagcagcaaggtctcttcatgttgttctctagggaaggggtcagccacaaaaaggcaatagttatacaactttgtaacaaacccacatcctgtatctatgtacattttagaggaaacaccaaggccttaggttatcattattgcaaaggaaaatgctacagttatcataatttactg

SEQ ID NO: 382684 - DNA, 540 bp, Homo sapiens
atccagcaaggatggggccgctcgactgggaccagagctgtctttgcacaccccatgacacccagaacaggctcaggaaagcaggaagtacctgggggctgcggccggaaatgtcccaaggcctccctgtcgcctgggtgcccacggggctctgactttcccccgttaccagcctcgtggctgtccccggagatgctgagagtgacagcttgagagtttgattcttacataagcgggaagcagtgagaagtcacccgcccaccacgtccctccgttcctgttggcacccccccatcctaccatctgtggcccccgtgggccctgacttgctaaggcgctggcgggcatagccttgggagcactggggtacatacatggccttgtagcacgaaggcccactccaaggttctggccaggctggactgtaacagcagtaccagcaccaggaatggggccaccatgtgatctttgggtagaaatgacctttttgggcttgagtttgtctttctagaatgcacgtgatcccttatcccagggagg

SEQ ID NO: 382685 - DNA, 1023 bp, Homo sapiens
ttaaaaacaaagctctttgcattgaagaaatattaaagcctttaaacatcaaagtttcctggagatttcctgcctgcattagatagagtactcctgtggaaactgcacacctagctcagctgcaatgtgtccacttaatttctgtggaaatacgcagctttataaccataacactggagtccctattgcattccagatttatcttgcactcaccctcttcacttctcaggtcactttagcgttcatagaagaaaagcaaaatctcacattatcaagaaacaggaagaaaattactacattcttaggcaatttggagtttatttgcaatcctttttcttccaagcaaaagaaagcaaggaaatgctgatccagtgttccagtcattttagctaaacaggttaagtagtccctttctgcactcctgcctcgctgagcgtgtaagatacaaggaagaaactcactcagataggctcctattgtcccctcacctgctggttgcctttttctccagagttagcagctgtctggtacgggagggatgctgcatgtggtgagagtttgccctcccaaaagtgccatacgctgcgtttagtagccatcccagaaacccagagagagcaggataaacctcaagtccaaagaggagaaaaggcctgccttaaattagattgaccctaaccctgggggtttctcagccaaaactctcttgacctttggggccagattgcccttgttgtggggctgtcctgtgcgttatggtctgtttagcagcacccctgccctgcccactagatgctggtggcacccacccacacgctcatgacagcccaaagcatctccagacatcgccagatgccccctgggggcacagctgtcccagctgagaaccactgctccaacttgatcaaactcaagattcatcaggagaatgagaaccccgtgttctttcattaattccgactgctctcagtttgcctcatatcagaaaacttacacgctaattccatctgttctttagatttt

SEQ ID NO: 382686 - DNA, 270 bp, Homo sapiens
gagacagcatgcctccatttttctcagtcatctcattcttgttctagggtggcccatttaactccaagccctggcatactctgtagccacaagtgtttgagggcttaggaatcaacaggatcaaaggctatcagccttaggaaaacagatctcagcttccctcagccatctcagctgatttgtttacatgaaaactcagtttaaaaggcattagttttctcctttcttatctctgctctgatgctgtactttctcaaaaaaaaaaaaggg

SEQ ID NO: 382687 - DNA, 524 bp, Homo sapiens
aactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctgggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaa

SEQ ID NO: 382688 - DNA, 304 bp, Homo sapiens
aagaaaaatagactttcatttagtacccgacttgtcatggagcttaaagataatgaattttaaattatctctctccagcagcccgccagtcacattgcaacatagaatccaatttccattttgcaggtgaatacgctgaggctgaaaacagttttgagtgctccagatcatccagtgaagccatgaccaaagcaaggtcaggttcatcggctcagggttccccattcatttctcagcacagtggctgagaattccagatgtaatctggcatactctccatgtaggggcctaagcacgtcactcc

SEQ ID NO: 382689 - DNA, 886 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaaaaaaaaaaaatttgggcggccgccggaagttttaacctcgtgggcggccagggtaggaggcatgtcagggacggggaggcggtcccaaaacgggcgggtgaacgaggttggttgttcgggccccccgcgggc

SEQ ID NO: 382690 - DNA, 360 bp, Homo sapiens
tttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatctgtactgtagctttgggcatccatgctaaagcaataaatattttctccttaaaactaaaaccagcaaagcacatcaataga

SEQ ID NO: 382691 - DNA, 1648 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatcttta

SEQ ID NO: 382692 - DNA, 1739 bp, Homo sapiens
acgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctcttttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382693 - DNA, 1867 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagagtcttgctcttgtcacccaggctggagtgcaatggcatgatctcggctcactgcaacccctgcctcctgaattcaagcgattctcctgcctcagcctcccagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382694 - DNA, 1725 bp, Homo sapiens
tttggtagagctggctttattgtgttatttattcacagttttatggatccattaaaaaggaattaatgtaaaaagtaacaaagaataagctcaaggatgaaacgacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382695 - DNA, 1408 bp, Homo sapiens
aaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382696 - DNA, 890 bp, Homo sapiens
gtcagtaggccttatttctcttgtcctttcgtacaggtaggaatttgaagtagatgaaaccgacctggattactccggtctgaactcagatcacgtaagacataaccgcggccgcggttatgtcttacgtagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382697 - DNA, 621 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataa

SEQ ID NO: 382698 - DNA, 1764 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgctgcaatttgaagatcaattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaagtgtacccacccagttcaaacccgtgtgtaagggtcaactgtacaaaaaagtttgtgaaataaacgtactggagaatctttaaatttttgtgctttttaatcctactattatgaatctttttagtttcatcttacattactactctcataatagctatccttagccaggtgccatggcacaggcctgtagtcccaact

SEQ ID NO: 382699 - DNA, 1416 bp, Homo sapiens
  misc_feature (1281)..(1281): n is a, c, g, or t
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtatttaaactgactcagtgacagctggggtggaatggcaagaacacttacaaccaaactcatgggctgcattgagatatggtataacttagacttatctttaaattgtcgtgtcaaaaanaaaaaggggggcaaattacccaggcagttcgctccgttttacaagggcttaggctaaaagacgggtaaacgaggaaccctggctggacctctgggcaggcccccaaaccggaaattgcatctccgtgttaatctt

SEQ ID NO: 382700 - DNA, 1277 bp, Homo sapiens
aggccgccagtgcccgccggccgcttccgctcccggcgcaggcgctgcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaagagtactgctccacagtccctgaggaccgctcttacggctcccgattgttccttacaacgccggtctgctgcgcgccgcgggctggcgcggctttacaccgcccgccaccgcgggaggccaactcacccaacctggctggccgcaattgaccacacacctcacttcaacggccaaagtgggctccaaacaaaaaccctcacggaggcaaaacgccacgaataaaaccaca

SEQ ID NO: 382701 - DNA, 1616 bp, Homo sapiens
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaagaaaagc

SEQ ID NO: 382702 - DNA, 375 bp, Homo sapiens
ggaagagacttgtgcgaggtcacacagcatgtgtggggcacagtggggagcagaagccaggcctccagccgggacaggggttccctgttccacaccctgcccagagcatctcacatgttgtctgggaggttgggagttgcgtctgaggaggggtccagtccttgaaactgcccttggtccctgcgaagttttcttctgaggagtggactttactccacccaccctccaacttcctcatttcttttcaggcagtgctggagacctggggcttcaacaccaaccaggaaatcttccaagaggtaactgccccctgcccctgtgtggggtttatctcacgtaccccaatcctgctctggcttcaagagcccccacaca

SEQ ID NO: 382703 - DNA, 472 bp, Homo sapiens
caattcttcagtgatggtgaaattcctctttccacgcccagaccagcaacattctgtagcttacacatttgaagaggtgaggcgggtgcagggagaggtggtggtgggggaacctgactcacatatgggccgcagagggcaggggcctgggggtctctgaagcctccagatccttctcaccacctctgctggcactggttgtctcttgcacatggctccttacaatcaaaatcacatcatgcaagtaacgagggggtacacacgtggtttccacagcttaggtaatattttctctcttttcttatttttattttttttagagacagggtctcactctgtcatccaggctggagtgcagcctcacactcatagctcactgcagcctcgaatcctgggctcgagtgatcctcccacctcagccctcctgagtagctgggaccacagacaaacaccaccacacctggctaattta

SEQ ID NO: 382704 - DNA, 1796 bp, Homo sapiens
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaagaaaagc

SEQ ID NO: 382705 - DNA, 869 bp, Homo sapiens
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagaagcctgggttggatccaaggcagctgttcacaaaatttcatcttccttcaacccctgaaagctgggtccctgaacagggaccggaatcctgccaagggagaattcaacgctcacttcttcttaaaccattcatgggcgccggaatttttgggctcccaggacccaggtgtcctggcccaggcattcccttttccacgcaatcggcacgcaca

SEQ ID NO: 382706 - DNA, 434 bp, Homo sapiens
tacccctaaggccaagctcagcaaatagtagactcctgttgtagatggaatcttatacatcatctagaatagatattttatagaaggcaactgatgacgaatgattgttttatgaagttttaaaatgtaaaaaaatcttacaacctgtggctgtttcacaggcccatgcgatcttatcagaacagtggcatcatattttcttcctacataataacaacaatataatcagattacattggagtagtaaaaaaatgtgctggatatatctgttaatatttcttcctagttatgaagtatagaaataaaacaattatgttattaaagagaagattttggctaaaatagaaaataaagatctgtataattctatatacatatagattgatgtaaataaataattttatttactaagaataaaagtactctctaattag

SEQ ID NO: 382707 - DNA, 385 bp, Homo sapiens
agcagagtctcctgtgggtttgcaatcttcagtccagaatttggccatgggggtagagacggcctggaatcacacaagttattgattggcttatgcctcaccttctgtgcttgcataaagccaggtgtaagaactgcagggctggctactgggaaatgacagggtgtgcctgtctttcaaatgagtgcccatctgggtgagcagactgttttcaacagcttgatagcagcatcacaatttttccatctatattacattcggcagagaagagttgtatatataaaacaaaaaccaaaatcctacagattcttattttctctatctcccagattaactcagaaatctttttgcccaaacttaaataaagccatgtttaataatcata

SEQ ID NO: 382708 - DNA, 331 bp, Homo sapiens
gatactattatgtttgacttcagctacaaatcctgtcaatcctaagtgctattggatttcagaggagggagaagtgttaagatgtccagcgcccttctctttacctaagctctttaaaggtcagtttgagcagaacattgagcatcacggagattactaatattcctttcattagaaacaaagagattctgaggtcaggtaattagaatcatgaacaacccatgtgaattcttctgtgtttatgtgtctgtgtttgctcacacgtgtgcacacactcacatgtgcacatgttccatacattcattcaggaatcaaatattaggcaactact

SEQ ID NO: 382709 - DNA, 3621 bp, Homo sapiens
cccacagggggaccggccctgtgacccctcaccggggccgtgggcccgagccccggacttccctaagccggcaatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccgggggctgcctgtcgcctccgtgacttccatggagcccttggacctgtctggagcccgggaggccctgaggaaggttcgggacgggcccagggtcacagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggactggagccgggcctcgtctttcttggcttcctcctggtggttgggatggggctggctggggccttcctggcccattatgtgaggcaccggctacttcacatgcaaatggtctccggccccaacaagatcatcctgaccgtggacgacatcacctttctccacccacatgggggcacctctcgaaaggtggcccaggggagtcgatcaagtctgggtgcccgcagcatgtcagacattcgcagcggccccagccaacacttggacagccccaacattggtgtctatgagggagacagggtttggctgaagaaattcccaggggatcagcacatagctatccgcccagcaaccaagacggccttctccaagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgagaagtgaggcccggccccggacagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatactgtctt

SEQ ID NO: 382710 - DNA, 550 bp, Homo sapiens
tgcattgacctctacctgctaggtggcccaggggagtcgatcaagtctgggtgcccgcagcatgtcagacattcgcagcggccccagccaacacttggacagccccaacattggtgtctatgaggtgagcctgaccccagccagacagagagacagtgggggaagaatgctcaggccctgggcagaggggaggcgcactctcaggaggacatgtagtcatgtcaaatcctgcaggctccaggagatgggggatgggagcccagacaggatctagggaaaggtcatggatccctcaaagggaagcacctaggaatcttccctccccaaggatttttctctagccactatctgggtaagggctcctcaaaagctaaccacagtgacccagagactggaggctggagctgccagggagcatgctgggaccagcaggtaacatggtgtggccactgagaccatctccggcctggtcagagcctctggccctgcccctcagcattccacccaattcagaccagactcaggaatagcaacccctagagggggaaaa

SEQ ID NO: 382711 - DNA, 2025 bp, Homo sapiens
taaaccatactcagtatccaaacagtggcctttgactatattgttttttccaaaaataggactatgtgtagaagagagcccccgtacatactttatcaaccatttcatccaccatttgtaaaaatctcatcttctgggtctggatactcaaaaacagatcttgattaacagccccttccccacattgccctgggcagaaaatgcaagtcaactctccccctctcagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgagaagtgaggcccggccccggacagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatactgtctt

SEQ ID NO: 382712 - DNA, 538 bp, Homo sapiens
gcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggtcagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtctt

SEQ ID NO: 382713 - DNA, 352 bp, Homo sapiens
acgtttttcttacgtggattgttgtaaccatcctgcgggatctctaacagccttgtcacatcagctttgtccgatcctcctaggagaggatgtactcatcattcccttagctcagcccagttgtacccttgagatctccacatactgcaacatcaaagctaatttttcccccttcttaccacatgaccaaactaaaagacacctgcatgattccccaggtttaaagcaaagaaacccttggtccctgggtggaaaacttggaaaggtaccatcagtcaaggccaagtagcttttcttacatgaggagctgcactggcaggtgagccccgagttggtgtggaggttggcacct

SEQ ID NO: 382714 - DNA, 1492 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcc

SEQ ID NO: 382715 - DNA, 1615 bp, Homo sapiens
  misc_feature (1069)..(1069): n is a, c, g, or t
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagtaaggagggagatggaggcatcatgtctgttagggaaagcaggagcctctctgaagacctttaacagggtcggtggtgaggnctgggggtcagagaccctcaccttcacctcctttcccagagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcc

SEQ ID NO: 382716 - DNA, 1414 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaaagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcc

SEQ ID NO: 382717 - DNA, 940 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcc

SEQ ID NO: 382718 - DNA, 1384 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagt

SEQ ID NO: 382719 - DNA, 1315 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagagccatcttcccagcctttctttaccccaatgtagtcttcgtcgtcctgcatactagttctagatgtcctagctgacctaggtgctgtgttggctgttgtgatgtgttggacggtagagctcagttggaaaaggtcgggtgctgctctcaggctgcgtccagcaacagtgcccagggctctgatgagtctctcatcgcttgtaaagcctgagacagctgcctgtgtgggactaagatgcaggatttctccacacctctcctttgtagcaagagatgcagaggctcttgaagtcacgtcgaccgttgccaatttagtagtagtagtaggc

SEQ ID NO: 382720 - DNA, 1264 bp, Homo sapiens
aacatatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcc

SEQ ID NO: 382721 - DNA, 392 bp, Homo sapiens
cataaataaatttgtctgtgtttgaatatacaactacagtcagccctctgtatcaatgggttccatatccatgaatataatcaaccacggatcaaaaacatttggataaaaaaaggatggttgtgtctgtactgaacatgtacagaccttttcatgtcattattccctcaataatatagtgtgtcaactgtttacatagtatttatattgtattaggtattataagtaatctagaaatgatttaaagcatatgtaggatgtgcataaattatatgcaaatactacaccattttatagcagggacttgagtatctgtgaattttggtatcaggagtcccagtaccaatcccctgcagatactaagggatgactgaatatagcttaaaaatggg

SEQ ID NO: 382722 - DNA, 614 bp, Homo sapiens
  misc_feature (22)..(22): n is a, c, g, or t
tgtaatcccaactacctggaangctgaggcagaagaatctctgcctcccaggttcaggcggttctcatgacttagcctcctgagtatctgggattacaggcgtgcaccaccatgcccagctaatttttatatttttaatagacacggggtttcgccatgttggccaggatggtctcgaactcctggcctcgagtgatcttcccactttgacctcccaaattgctggcctttgggaggccaagttgggaagattataggcctggccgacttgtttttttaaagctacctcattgagaatgggcaaagaagttatgttggcatgtggtctcattttccaggactttcccgtgaaatattttaccctgggggcctttgactcaccccattgtaaagtttggcagttttgaaagttcagagggtactttatgggctataaatgcagaaaaacagaaaaactttacctagggtaaatgacataggacctcactgctgtgatcgctctgtctgggtggattgccccttttaaagaaatcttaaacataattagacaaatcttttctgattatcaaaggaacatgctcattattttgatattggaaaatacagaaaattac

SEQ ID NO: 382723 - DNA, 206 bp, Homo sapiens
tctccaaggtcgtacaaaaaccaaagctacaggtctgagagtcttgcttgtgtaccattgagcagatgatagatctaatgtttctaaaattaagtaaaagactaattgagcatatttgtttaaggatttttggtattttataaaataaacttatatgttctctaatctctgaaacgtggtcagatgcagatgctattttaaagacc

SEQ ID NO: 382724 - DNA, 447 bp, Homo sapiens
attaaggttaaaaaaagaaacacccctaaactatgaaactatctttttgctaaggcacttgaataggagcagcaaaaaattaacaaaaaatactgctactgacagttctccatattgagaattttcttcttgacttagtacttttaatttttatagtagctgccactgccattagtggcagttatattttttgtgtttattgaagttgacagtagattgagtttgtgtatttattttgttcctaaagctgattattattaagtgtattttttaaagcatggtttgctcttctataaaccttctggggacaccaccactctcactttcttaagtacaggattatcaacaatgttgctacttactagtttggtctagtccttatgccatagagcattcattgcccaaagcaggaggtaccataaggtcaataaaaaacatggctggtct

SEQ ID NO: 382725 - DNA, 761 bp, Homo sapiens
aaatcatatgatcatgccaatagatacgaagaaagcatttgaaaaaaaccaacgcccatttatgaaaaaaccctaaacaaagtagaaatagaaaagaacatcttcaacctaacgaaggacatctataaagagccaaagataacatcatatttaatggtaaaagaatgaatactttctccctaagatctggaacaaggcaaggacgttgtttttaccacttctagtcaacacggagggtgtttagccagtgcaatgaagcaagaaagagaagctaaaggtgtcaagattggaaagaaagagtaatactgccttgattcacagatgacctaatcctgcatgtaaaaaacactaaagaacacatacacattcattcattcattcattctctctctcctctctctctctctctgtctactggaactaataaattagttttgaaaggtcaccaaatacaaggtcaacattatttctatatgctggcagcaaatgatctaaaaataaaattaagaaaacaatttcatttacaactgcatcaaaaagaaaagatacttagaaataaattttagaagtgcaagtatagtataccaaaaactacaaaacattgctgatagaaattaaagatctaaataaattgagagagattctttgttcatggatttgaagactcaatattgtcaaaattgcaattatattcaaatctataaagtgaacactatacctatcaaaaccattgtagggttttttggtggaaacttacaggc

SEQ ID NO: 382726 - DNA, 434 bp, Homo sapiens
ttcaattacctcccactgtgtcccttctacgacacatagggattacgggagctacaattcaagatgagatttgggtggggacacagccaaaccatatcaattatccagcaaactcaccccgaacacagtcagtcactgctccagccaaactggccttactaagcactcaatctctgcctaacttcattttgccaaatgggtgactaaggccagcaaagtagctcacgagttctgccaactgggaaactcatcccagtgcttcatggaaagcccccaatatgtccatcaggtcagaggagactggtctaatttagggagattcggctggtgctgctgtgctgccctctccccctcacccgctccaccgtcagcactcctgtgcaactcaaaaagccatttgaaaacccccactccggaccactggctcctccaca

SEQ ID NO: 382727 - DNA, 590 bp, Homo sapiens
catatctagattatgcaagaacctctgaattaatctcccaatttccagtcctcttcagtcttcagtcttctcctctagatgcttagatcttggtcctatccttgaccactctctttctttcagaccccttatggaatccaccagaaaatcctgttaccctgtcttcagactaaatctggaatccagcccctgttcaccatgggtcaccactgattgaagcctccagcatctctctgcttaatgcctgcagcagcctcctggctggtctcctctttccctttagcgcctctcatttattctcaacacaatggccagggtgatttttttttaaaactaagtttcaacatgtcactctttgcttaaaacctggccacatccaagtcttcatgatgcctttcatattgatgctctctaacttcatctcttgctactcttctctgcctcactcactgccccaaccccattggcctcctcagtcagttgtgctcctacccagactttgcactgactgatcctccttcctagagcacaccacccctccatagccacatagttaactccctccctttttcaaagtttctcactttctc

SEQ ID NO: 382728 - DNA, 393 bp, Homo sapiens
gaccaatctccatccagtccacactccatccagtccacaccccatcaagatcactactccatccagtccacactccatcctgtctacaccccatccagtccacaccccgtccagtccacaccctgtccagtacacaccccatccagtccacaccccatccagaccacaccccatccagtacacaccccatccagtacacaccccttctagtctacactccatccagaccacaccccattcagtccacgttgcatccagtccacaccccatccagaccacacctcacccagaccacaccccatccagtccacaccccatccagtccacaccccatccagaccacactgtatccagtccacgccccatacagaccataccccatccagaccacac

SEQ ID NO: 382729 - DNA, 2026 bp, Homo sapiens
cgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382730 - DNA, 2230 bp, Homo sapiens
cgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382731 - DNA, 1338 bp, Homo sapiens
tcggatagatgtgagtggagaggagctcccacctgcccctcttctctttcagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382732 - DNA, 1505 bp, Homo sapiens
cgagactgcgtctcaaggaacaacaacaacaacaaaaaagaaatgggacagaaagttgtaaggccagatgtgggtgactcaccgactcgcagcgatgtcgaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382733 - DNA, 1044 bp, Homo sapiens
cgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaagagtcttgctgtatctcccaggctggagtgcattggcgtgatctcggctcactgcaacctctacctcctgggttcaagtgattctcctgcctcagcctcccaagtagctgggactacagaaatcatggcatgtcacctgtaatttcagtgtgcatctctaaaaactgatatttttctaagttatcatgtgattatctcagctaatgatattaacaggagttctttaatttcatctaatttctatgtgtgttcacttgtccgccaaatgtgctgcctgttggtcttcacattgtccctgagctttgtgcctattttagctgtctctctgaggttagagtgaggccttcttccctgtatctttcagggtatttttttttccttccttccttccttccttccttccttccttccttccttccttccttccttccttccttccttcatttcctccctccctccttcccttcctcccttccttcctttctatttttttttgtttgtttgtgatggagtctcactctgtcacccaggctggagtgcagtggcacaatcttgcaatctccgtctcctgggttcaagcaaatctcctgcctcagcctccagagcagctgggattacaggcatgcaccaccacgcccagctaatttttgtatttttagtagagacaggtttcaccatgttggccaggcttgtcttgaactgctgacctcaagtgatccacctgccttggcctcccaaag

SEQ ID NO: 382734 - DNA, 2348 bp, Homo sapiens
cgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaagagtcttgctgtatctcccaggctggagtgcattggcgtgatctcggctcactgcaacctctacctcctgggttcaagtgattctcctgcctcagcctcccaagtagctgggactacaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382735 - DNA, 2032 bp, Homo sapiens
cgcacggttcccagctaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagttacgactacctcacttccctgaagagtgtcccttatggctcagaggagtacttgcagctgagatctaaggtgcaccttcgctctgccaggcgtctctgtgagctctgctgtgccaaccggggcaccttcatcaaggtgggccagcacctgggggctctggactacctgttgccagaggagtacaccagcacgctgaaggtactgcacagccaggctccacagagcagcatgcaagagatccgccaggtcatccgagaagatctgggcaaggagatccatgatttgttccagagcttcgatgacacccctctggggacggcctccctggcccaggtccacaaggcagtgctgcatgatgggcggacggtggccgtgaaggtccagcacccaaaggtgcgggctcagagctcgaaggacattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382736 - DNA, 1655 bp, Homo sapiens
atctatggagactgaaaaggggtcagaaccacacttatatttaggattttgctgggggcatttatctgcttagagctgtgaagagtgtagggacagggatcgtggggaggccagaccccaaacttaaagaccaggtaggtcaagggctgtggcgatgaccagcatgaagggctaatcctggatcctaggccagggcatcagaccttgggccacaggtgggatgagactggctctcatgcgaggacagtggtaagcaatggagcgtgagcagcagcatggtctggcagggtgcaggctatggggcaggactttggagttgggttgaagtcaggtcagcctgagctaggcttggaggggtaggagaccagactcagctggtactggcttctgggggtccttccagacctgatctaaaattgcggccagtgaaaaagccatggagaataacctggtctctcgcaatgtatactgtgtcacatccaacgctttcctagaagtttggctgagatatccccttccgggtttgtcaggctatacagtgccttgtgctagacttctctatggggagtgctcctagcagtgccaagacagcggtgcctgaagctccctcctggggcttctttgcagccctctggtcacagcctgccagacccctgccacccctggccccactgcccataccaaccatctgtttctgttgccccattgctgcttcaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatccttctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttgcaggatttgtc

SEQ ID NO: 382737 - DNA, 533 bp, Homo sapiens
caatagagcaagactcagactcaaaaaaaaaaaaaaaaaaaaaaatcttcaaatggcacctgatatcctgcagctgtacatcccaaacacagaatctaagattaacgctgatgaaatgagtacggaacaaggacaactttgtgaattttttctaaagttaaagtattcaatggattgtttattgtgagattttgcttcctgcttttttggtgttaaaatatccttttgtttatgaaaagatagatgagtaaatgatagtttttaagaaacatctccacctagtaaacagaaaagttggcagaactacagcagctgagttttattttatattgtaatggctcaatacaaaaatgtcagggaaacactgaatgaccggaaatccaagaaatccaaaaggcaaacaaggccctcactgatttatttcctctcactttcccagacgttttgctccagcaatataagagtgcaaggatgtccagcatacaacctactaattatttccctttcctcatgctttcccatgaatggaatga

SEQ ID NO: 382738 - DNA, 585 bp, Homo sapiens
  misc_feature (297)..(297): n is a, c, g, or t
  misc_feature (312)..(313): n is a, c, g, or t
  misc_feature (316)..(316): n is a, c, g, or t
aaacaaatgtggaatgattaatgcaatctaatgcatatccctctacctcaattacttatcttttttttgtggtgaaacatttgaagtttattctcctagttttttcaaatatacgttattattgactgtagtcatcctgctgtgctataggtctcaaaacttatttctcctgtctgtctgaaactttgtatcttttgaccagtaactccctattccctcccctcaatgtcctcctttaaaagtaatttgtataatagtcaatgctgatacacttttttcagctttaagaattgtttntcggccgggcgcggnngcnacgctgtaatcccaatgctgggattacaggcatgagccaccacacccagccactgcttcatattctttatcttcaacatcaagtagcttctgggattatcatgataacctacattatactctagcttataatacattgtcagtttttaaggtcacttaatttaaattaaccatttcatgaaacaagagtaaattaatgttaaattatttcaggaggaaggatttaaattttggtatgttttacctatattaaaccactcacagttgtgt

SEQ ID NO: 382739 - DNA, 155 bp, Homo sapiens
caccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaa

SEQ ID NO: 382740 - DNA, 811 bp, Homo sapiens
gcctgatatctccgctctattttacagttactcccctgctggtgcctccctccttggcgcgcttcccacctgcgatcggcgccctcttcgcagtcacgaactcgccagcagctagcagcactgactagtaggagggcccgccggaggagaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaag

SEQ ID NO: 382741 - DNA, 1764 bp, Homo sapiens
acacacgggcgggcggaggggacccggggcgagtcatcaagggcgcgtggttcggcgtgccaggcgcgctgctctgcctgctctcttggcttctgtctcccttcgaccgatcgccccctatcctgaagctttccaatgtcatcttggagccccaaagtttcctggggcctccgcgttgtgcgtcccagaaccccttgcctgcccctgagggaaacgcggaccataggcagcgggacgtcgggagccagcccaggggaggccagattcagcatttggacagcggctctggggcgcagtcggcccagcgagtttgccggtgaacagcctcgggcagatggcgggtaggagggccgcaggctgctctgggtcttggagaagcaggacccagcctagagggcatccccagctccgaatgggacacgttttcccgagataaaagatcccttctgagctcacacgggagccccgggaccagccaatccagcgtggatatccccagcctaaccaacacctatgctggggggaaagataagacgccccctttcagccaggaggtggacgaccctcatgccctcagctctccattcttcccaaagcagctcggatccctaagtctggagctgccagcgaggcttccaacccgctgcttgccatcacctcccaggtcgttggtggctccgattactcccctgctggtgcctccctccttggcgcgcttcccacctgcgatcggcgccctcttcgcagtcacgaactcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaag

SEQ ID NO: 382742 - DNA, 1687 bp, Homo sapiens
acacacgggcgggcggaggggacccggggcgagtcatcaagggcgcgtggttcggcgtgccaggcgcgctgctctgcctgctctcttggcttctgtctcccttcgaccgatcgccccctatcctgaagctttccaatgtcatcttggagccccaaagtttcctggggcctccgcgttgtgcgtcccagaaccccttgcctgcccctgagggaaacgcggaccataggcagcgggacgtcgggagccagcccaggggaggccagattcagcatttggacagcggctctggggcgcagtcggcccagcgagtttgccggtgaacagcctcgggcagatggcgggtaggagggccgcaggctgctctgggtcttggagaagcaggacccagcctagagggcatccccagctccgaatgggacacgttttcccgagataaaagatcccttctgagctcacacgggagccccgggaccagccaatccagcgtggatatccccagcctaaccaacacctatgctggggggaaagataagacgccccctttcagccaggaggtggacgaccctcatgccctcagctctccattcttcccaaagcagctcggatccctaagtctggagctgccagcgaggcttccaacccgctgcttgccatcacctcccaggtcgttggtggctccgattactcccctgctggtgcctccctccttggcgcgcttcccacctgcgatcggcgccctcttcgcagtcacgaactcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaag

SEQ ID NO: 382743 - DNA, 1223 bp, Homo sapiens
acgacttgttcttgccttctaaagcagagaggagcttttgtgggtagttcctacagggatacatggtagaaaattcaccaaacccagtgctggagtgtttctcttcctcagaagaaatcagatgctgttcagagcacgaaggctagaattttaccctggttctcatgctaccttgcacccaggttggatcctgagtacagtttttggcaggaagccccagagagattggtgagggtgatttcccaggaagacgcagtgtgctctgacttctgtgacagtgagcaacgggaccagtggatgtccagatgctggcaatgagacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagaaggtatatcgtctcaaaatgcaggggacttcagatgagttttgagcaccctttcttttattataaaaaaaattccagacagttcagccaatactgactaagggctgagaccagttccatgcttttctgtctccagaggaatttgcttccatctggatgcctgaaacgctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaag

SEQ ID NO: 382744 - DNA, 1446 bp, Homo sapiens
agctgggagtggcgcggctgcttcccgcccgcgcaggatcaggccggcccccgcgggcctggagctggatccagagctagggaaactggaaaaacaggcacaaactcggaagccgcggtacggcaagagcctaagcaaagaatcctttccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctccttcttcaccgtgtctgttcttgtcacacctagtcaggtctgtttgggtctgaggtgcatggaacattctgggtaggcctccagcaaacggaagctcttcaccgtgtttccagcctgggaccaag

SEQ ID NO: 382745 - DNA, 401 bp, Homo sapiens
gcctagaaagctctagattgtccttgaagatcattaaggtgaggttagtgtgagtcaagaatgggccaagcccatggttccctgaatatcttcttaataccagtaacctataatacagtacaagggggaatggatcatgcctttccagctatctcagaggtgagaaatagtttaggggcagggaagggaaaagattttcatgtggccatctgaaaggagatgggaatgggctgggggcagaaaaacaagctgcattaagaacaaatgactctggtccaggcgcagtgtcacgcctgtaatcccaccagttaaggaggccaaggcagacagattgcctgagcccaggaggtcaaggctacagtgagccatgattgtgccactgcactccagtctgagccata

SEQ ID NO: 382746 - DNA, 370 bp, Homo sapiens
ctaaccagtaagataaaagtgctgtgttcaatttcaagggtctgtcaggatgaactggcagtctagatataattggttctagggctgggcacggtggctcacacctgtaactcaagcactttaagaggctgaggtgggcagatcacttgaggtcaggagttcgagaccagcctggccaacgtggcaaaaccccatctctactaaaaatacaaaaattggccaggtgttgtgacagacctgtaattccagctactcaggaggctgaggcaggagaatcgcttgaacccgagaggtggaggttgcagtgagccgagatgctgccactgcatccagcctgagtgacagagcgagactccatctcaaaaaaaaa

SEQ ID NO: 382747 - DNA, 459 bp, Homo sapiens
  misc_feature (1)..(1): n is a, c, g, or t
  misc_feature (4)..(4): n is a, c, g, or t
  misc_feature (9)..(9): n is a, c, g, or t
  misc_feature (24)..(24): n is a, c, g, or t
  misc_feature (28)..(28): n is a, c, g, or t
  misc_feature (31)..(31): n is a, c, g, or t
  misc_feature (412)..(412): n is a, c, g, or t
  misc_feature (417)..(417): n is a, c, g, or t
ncancgtantggtaggtctccagncagnggnttctctggcagggtcaatgggtcaaatggactggggaaatcactggggtccatgagtatggctggatatgtactgaggcagggttagtgcaaaggctacaagcctagaactgcagacagcgacggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatcttggaacaacaaggatcggttggtnggggnaggctttgttcttggagggttcccttcccatgaagttccttg

SEQ ID NO: 382748 - DNA, 6207 bp, Homo sapiens
  misc_feature (457)..(457): n is a, c, g, or t
cagacaaggacagaaagggggctggaggagaaagagagagagagatacagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggncccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacaatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382749 - DNA, 4080 bp, Homo sapiens
cgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgtgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382750 - DNA, 1375 bp, Homo sapiens
ctcctgcctgaactcattcctgaccagtcatcctgccctaactcatccctgaacggtcctcctgaccgaactcctccctgaacggtcctcctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382751 - DNA, 5137 bp, Homo sapiens
cgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382752 - DNA, 4188 bp, Homo sapiens
cgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctaccccaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgca

SEQ ID NO: 382753 - DNA, 305 bp, Homo sapiens
aaaggggagatgatgcgagagccaagccagcaaccatagtttgaccttccctaacctcctttctccaacactagaagtactgagataaagccaaactttgctctccccccatctcacaaggtcatcaaagctgttcctggggctctgtgctatggaagcttgctgtgtgcttacatcagcccctgccccggccagcagtaaatatggtgctgactagctttcaccttgcctctggccttacctctgccatgcccctgctttctcttcccctccagggtcaaaagcggctggtgctttccgaaagc

SEQ ID NO: 382754 - DNA, 5710 bp, Homo sapiens
cgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382755 - DNA, 1671 bp, Homo sapiens
  misc_feature (6)..(6): n is a, c, g, or t
aacggngtgatgcgttgagcatgctctccaacatgctgcggtccatggggatcacagaataccagagaggtgactcggcgatgcaggaccgttcaggttgcaggtagaacacatcgttgcgagtccggaggctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaccccaaacacttgtggggcccgccccaaaacatctcacccacctgggggcgggccccgtttgacatggccccgtcccgaacccgcagaacgggggttcccaaaccgggccggttgcaac

SEQ ID NO: 382756 - DNA, 2437 bp, Homo sapiens
  misc_feature (457)..(457): n is a, c, g, or t
cagacaaggacagaaagggggctggaggagaaagagagagagagatacagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggncccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatctgttatgttttatttttgaagctggctggtggatacacaggtctttgttacatcatcatctatactttttttgtatgcctgaaatatttcatgtttaaaacatttaaaaaataaaagtgaagggaca

SEQ ID NO: 382757 - DNA, 3492 bp, Homo sapiens
cgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaaggttttaaaaaaagaacattgggccccaaaccccatccttttaaaaaaggatattc

SEQ ID NO: 382758 - DNA, 674 bp, Homo sapiens
aaatatatgtcaataaaattgtattttttagaaaatttctcagtgccaaaagtatgacagcatatccatcacattttagggattgtgggataagcatgtagtgagtgtttaataaatagttattgtctaaattgctataaattttagaaattgtttcaagaaacttgaaatgcaattacatcattgcattaaaaggctttattaatccttgaataaaagtattagaggcctggtacagtggctcacgcctgtaatcccagcactttgggaggccgaggcgggtagatcacctgaggtcgggagttcaagaccagcctgacccacatggagaaaccctgtctctactaaaaatacaaaattagccagggtggtggcgcatgccagtaatcccagctgctcaggaggctgaagcaggagaatcacttgaacgcgggaggtggaggttgtggtgagctgatatcgtgccattacactccagcctgggcaacaagagtgaaactccatctcaaaaaaaaagaaaaaaaaaagtattaggtggatggttagcttttttgtttttcctttacaaggatctctttttattctatatttttcataggtttattcatgtttttaaataatactgaatgatagtaattattatatacagtgagtagtttttccatgatagggtt

SEQ ID NO: 382759 - DNA, 403 bp, Homo sapiens
gcttactgtcccccgcagagcacttggtaaacgagatatgaaattgtcctttaagaatggaggtttaattttccagtaggacagagtattcaataaatgagagtggagactatattttatttgtctaaaatatatgttttttaaaatgtgttcctcaatagctggtaaaggacaaagccagggagttgagagcaaagggtatgcacgagctgagatagcaggatatttggaaaagttattgtttcttttttttttttttttttttcctgtctcatgtcctcaacctggagtagtgactctggtgagtagaacacttcttacaggctcactgggaccctgccactaaattttcacctggagaggcagcctaattaagagagagtttgctttgaaatcagttaga

SEQ ID NO: 382760 - DNA, 277 bp, Homo sapiens
ggaagggaaaagacagcaatcttttttatcttcacatttctgtgtcatttggcatgttaaaaaaatagcatgtataattttgtaattgaaacctaaaatataagaaagaaaattattgaatagaaatggtaaatactatgcagccataaaaaagaatgagagcgtgtcttttgcagggacatggatggaactggaggctattatccttagcaaactaacacaagaacagaaaaccaaatgccacatgatctcacttacaagtgggagataaatgatg

SEQ ID NO: 382761 - DNA, 676 bp, Homo sapiens
aattgaaagattggggtggactgacttttcaaaaagctaacttgtgcgtgggaaccagaaagacttgtgtttttcatcaaatgcagaaatcggtattgggggtggtggagaaattcacataatgcattttccatgaaatagcatcgttgtggagaccgctcttccgaatggaaagtcagagtcgtgcagaacattggcgccatcaggtcgtgtatagagcaggatttcgttgaaagtggaattaaacataaagattgcataatttgatgtctaatcatcagcaagtggaacaaaacctggattgaatagacggtgactcgatctccgtacagactgaggtccaaaggtctgcgctcacttctggaactttccttttgggccttgaccgaactcctgttattgtgtgcagtagcagaggctgcgctgcgtggttcagtttgtgcaaaggctatttattgtttctcatttactgaccactcgggagaagcctttagcaatagtttttcccgacacaaacttgaataaagtcgacccctgcagttcttcctgaggctctacaagcttcctggatgcaggaaccatgtgctgttctgacgacgctccgaaacctagttcagtgcctggcactagacaataaaaaattgctttctgaatgaaagtatatgctggcaggcgc

SEQ ID NO: 382762 - DNA, 459 bp, Homo sapiens
catagtagtcttatgctgaaaggctcccctgtaaaacattaacaaagggagctaatttattttgaatgtgctcaactatttaatgatgtttacaaaaatctgtgatcattaagtttgtggggtttaaagctaactaaatttttaaaacttgtataaaatactttgccaagttttctatgacatttatgtcttcatctggttttactcttaaattgtagactcctgtaaagagtatgtattttttttggctttgtaaatcttcttagaacataatacattgtcagagatttttttcttttttaaaaaatgacacatattaccctatagtaaaattatataaatctacctgaacttcatttgctccacctttttatttccaagttttaaaaaatgcagcttagcctaagctttattagttatgcaaagtcaaaataatgaaaataaaatgagattaactgg

SEQ ID NO: 382763 - DNA, 1185 bp, Homo sapiens
  misc_feature (397)..(397): n is a, c, g, or t
  misc_feature (1030)..(1030): n is a, c, g, or t
gtggatccgtgagagcatcagagaaccacggcattttcctacatcactgctgtgtgctttgcacagatgcaaaatgttaaaagagttcagaggctgcaggacttggcagggctagggtaagttggaaaagccttcctaagagcctagatatttggacagggcgtgcaaggtgggtgtgatttagatgtgagaatggagtttcatgcattccacctaaaggaatgtagcagaatgggacgtcctgtaagatacaggcacatcgagaatttacactggaggccaaatgaagtagacagggaaacaaggggaaggaattcttggtgcaaaaccaactgtgaggggctgaaatgtggcccccagattcctaacccccaggacctcagaatgtgactgcatntgaagatagggtttcatcaaacaggactggggtccttacaggaaggggtgatcacgacacagacacacacacagagggatgaccatgtgaggtcacagcaagaagacagcgtctgccagccaaggggaggccttgggaatccagccctgcccacatctccatctgggacttctggcttccaggactatgagagaataaatgttgttgaaaccacactatctgtggaattttgtaatgacagccccagcagaggaacaccagccttgaaagctttgatcaaaagctgtccattattttataacatagaactgtggaattccaatgtggatttagggttctgcattctctgctgtgctgtaagctccaagcaggaaggggctgtgtgtgcgggaactagctcagtgtctacctgtgtcccactccgggcaccgggcgtcacgtgcacagagttgagggtgacacctagtatgtgcggaggacctgcgtttggcacaggaacggacgatcagttgtggatgctgtattacaggaagacgccacttagagccatcgcagtcaatttgacctttgtgctgggagagcatcaggaatagatggttccaggctaagtaaaagtttacctacatgctgcanagatgccttggatttcaagccagcacgggctgctgcggctgtatttctggagtcagcagataatgaattattagatcaccagctaatgaggtaacgctgtagcataccacatgctttatgccaaaaataaaaaattgatatacggcaccagacgc

SEQ ID NO: 382764 - DNA, 370 bp, Homo sapiens
tcgggcttcgttctgctttaaattggaccacatgccctctgaggtaaaagagggacactccccagcccgagacaaagtcccgtttccttagaaagtcacacacacgatctagatgcaccctgtattttcctgacacgttctttatacccctgggcctgtgggctcttccttacgactaaaatccctggacacctctcttctggagaactgacactcatctttcaagacctagctcactcccccactctctgtaggcctatgcagaggactagcttggatgaagccggtacccagcctcccggcacacatgcacagtgctgctgttttccttccacacctctctccttgcggtacaggacctgcttggttc

SEQ ID NO: 382765 - DNA, 415 bp, Homo sapiens
acaaatcgttgttccataaatgaatgaatgaatgaacctgtcacatagtggcaaagcgtgaccaaggggcttgactctggatgaaatctgtcaaactagaccagaaaaccaaaggctaagaacctttgttttgagcaggagaaaaccctgtcttttcgacagtcttttcttatgttgtatgtattttcttgctttgcctcctgtcctggcctggaagctcactgagggcagagtcctcatcttaactcttccctttttttgagacagagtcttgctctgttgcccaggctggagtgcagaggtgcaatctcggctcactgcaatctctgcctcccaggtggaagcgattctcctgcctcagcctcccatgcagctgggattacagacatgtgccatcatgcccagctaatttttg

SEQ ID NO: 382766 - DNA, 188 bp, Homo sapiens
gagattgtgtgtctcggtgtgctttctcagctctggtgtaaggaacacagaaggttgaatgtgcttctggttatgtcgggaaaagaccagggaagtgtcgtgccattaaccaaaaccagaaatggatgctgtttatgaaagcagccacagcatgcctggtgctttttttttttttggagacagaatct

SEQ ID NO: 382767 - DNA, 375 bp, Homo sapiens
ggggaggggttttgggaaaccaaaatttggcccggggccttccgaaagggggccaaaaaaaaaaccttttcccccaaaaaaaaaaaaaaaaaaaggaaagaaggacttcatttttcacactccagtttgtctcccttctaggctgccagatctcatgcattcttcatttttcatcctcaaggtccaatccaagccctggcaattaataggcatgaattacctaattgttaaattactgagtaaatgagtgataaatgtataaattgaaactagggaagtttgtatagcaataggcaccttacagttttgttttgttatttggtttttatttcataatcataaacttaactctgcaatccagctaggcatggaagg

SEQ ID NO: 382768 - DNA, 1607 bp, Homo sapiens
atgcaaagaccacaatgcaggcctcagagattctgaagtcaactttacaaagctggtggacagaaaaactaatgattcttgaatgaaaataaaccaaacaagaacaaccctttattattaagtaggcctttgtatggtgggtctgtggaacacaactgtaatgtccatcacagtggtggctttacttggaaaccttctttgcttggctctttatgaccacaaccttctgctgaaatagtttgggattgttggtaagttatttgagctaaagacggtgtgttgggcatgcctcatagaggtggtaaaatatttttctcacgtcctgaaggaagatcttgagacctattcagctcaaagatcctagataaatccaaagtgttagaggaatagcatactccgtaggtgtatcacctcagatggctgactaaatcacggcatgcttgaggagcatgctcaacaagttcttactttatttacttggatcacatgaaaggagccaaccctgaggagtcgctgggctttgggctatcactttttgctgagaccaccaatagaaccttcttcagtactgaactggccttcaacctttagggcaacagagcagcagtgctccagaggaccttggcaagaaccatgccaagctgctactgaaggagtctacacaggcagatatgtggattctattagccagagcctgattctagaagctgctcatgatccaaattcctgctaggcctgatatctcccctggaacacagagtatttgaagcatttgaagaatttttttcaggttatgtttaaaattaaaaccaactcatgttgtgaaaaactcaagggcacggatagagtactgatgacttgtaatggaatggctttaccaacttaacaagaccattgtctcaggataagtccctaccctacaaaatgaaacagccaaggttaaatctaaggaacaagtttgaatgcataaattcagatcaggagaggactttcttttctatgaataaagaaaaccagaacctacaaataaaagacagctatatatcctcaaaaaatgacattcccaggatggtttcctcactgattaaaagaaaaatgttttagtgaatttgatgctaattctgttctagaacggtattatttgcagttctgttgtatattaatttggtgaataaatctagtaatgaaaagttcataatatgggaggctaaggcaagaggatcacttgagcctgggaggcagaggttgaggagagccaagattgcgccagtgcacttcagcatgggcgctagagccagaccctgtctcaaaaaaaaaaaaaaaaaaggaaagaaggacttcatttttcacactccagtttgtctcccttctaggctgccagatctcatgcattcttcatttttcatcctcaaggtccaatccaagccctggcaattaataggcatgaattacctaattgttaaattactgagtaaatgagtgataaatgtataaattgaaactagggaagtttgtatagcaataggcaccttacagttttgttttgttatttggtttttatttcataatcataaacttaactctgcaatccagctaggcatggaagg

SEQ ID NO: 382769 - DNA, 3194 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382770 - DNA, 3342 bp, Homo sapiens
gtggtcatcccgcctcagccacctactacaggaccgccaagaaaagaagttcccaaaaccactcctagtgagcccaagaaaaagcagcctccaccaccagaatcaggaaaaaccacctccggtcaataagcaggagaatgcaggcactttgaacatcctcagcactctctccaatggcaatagttctaagcaaaaaattccagcagatggagtccacaggatcagagtggactttaagaactcgccgtgtgtgtgtcagagaatgttgctcctgtgccctgagtcaacaaagacggcccctgtgagctcaagggcagttgggaaggtgtagcgaacatcctgtaaaacgtcccatcttgattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382771 - DNA, 3296 bp, Homo sapiens
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382772 - DNA, 3254 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcctgagagctctgcacagctggatgtggggatatggacatgatgatccatgggcttccagcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382773 - DNA, 1942 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgaggtagagcccccccgctgcctactgtgccctggctctggcgggagccagggcccacttgggcgcgcaccatcgccaccacgagcttggtggccccagagtctggcccttccccaggcagcgcttctccccctggtgcactccatgcagcaaccccatggttctg

SEQ ID NO: 382774 - DNA, 1165 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtgggtgccgccccgatgtcttgtctttaccagtggtctccgcagatggtcttgtgcgggtgggatgggccagagcatggagactgggattgggactggcaaggaagagcccttcctggggtctctcacaggttcagaacctgcctgagagccagggcctcctggattagaacaagcttagggggccatggatgcgtttctgggcatggccccgactgtccagggttgagaggtggactcagcatggagcccaggccctccttcactgtctgctgacacacgggccgtggggcctggcacagtggattcaggcttcagttgcagacgatttgtgactcaaggcctg

SEQ ID NO: 382775 - DNA, 686 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaaggggtaagtttttgtcttaatcattcatatttggaatcttgggactggtatagtctcaggtctgtccttgctcgctgggtacagcagcagctcatggcagtgtttgggccctgtctgccaccatgcaaggctgggttctaggcccccaggatagccccttggctggggccacaccaggacgtgtcgggtgcacgtcacaggctgcttgggcaatgggcggctctcctctcccagtggctcccttcatgcagcgatgtgcacctagcttccactctgatagggcaggggcccccaacccccagcactggactggttaggaactgcccacacagcaggaggtgagctgtgggtgagtgagcacgaccacctgagctctgcctcctgtcagctgagcctgttattagattcttacaggagcgcgaaccctattg

SEQ ID NO: 382776 - DNA, 642 bp, Homo sapiens
gtggtcatcccgcctcagccacctactacaggaccgccaagaaaagaagttcccaaaaccactcctagtgagcccaagaaaaagcagcctccaccaccagaatcaggaaaaaccacctccggtcaataagcaggagaatgcaggcactttgaacatcctcagcactctctccaatggcaatagttctaagcaaaaaattccagcagatggagtccacaggatcagagtggactttaaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgttggtgtcggtgtggtgtatctgggtgtgtggtatgagggtgtaggtgtgtgtgttgggtgcgtgtggtgtgtggtgtgtgttggggtgtggtgtgtgttggggtaaagaagctggagtggtggcctgtttggattcaggcccaggggccgagacattcccttcttcactcttttcc

SEQ ID NO: 382777 - DNA, 3072 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382778 - DNA, 2981 bp, Homo sapiens
caccaggcgcacttctgcacccaggcgcacttctgcacccaggcgcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccaggcatggtggggtctgaggcgtgtgttcccatttagggctgaatgaagccatgacttggaaaggtggtg

SEQ ID NO: 382779 - DNA, 1529 bp, Homo sapiens
ggcggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagcgtcgacgctctctctgtgggggaaaagggaggtccctggtttttggacttcaagagtgagtttggttaactgagccttaaggatcccctttaccctttcgacttttccggatgtctggggcccgcctgggatatggagacgccactggatgcccagggactgagaaacctgttgagtgatttgggagatgaagctaggggcccttgtctgattgtatggagcccgggagacccaatctagggatgatttctgttaccagaatttgggagacttctgcggccttttctgaagaggtaggaaatgcttctacccacctagagaaggtgtctataagagtaagaataaattttgtcctcttgacgggatgaatgtgggtgaagtctatgcacgtccccccaaccgagagagcgt

SEQ ID NO: 382780 - DNA, 583 bp, Homo sapiens
acactgcaggactgcatgtacaaggatgtgcagaaggactggcctggctactcggagggggaccagcagctgctgaagcgggtgctcgtccggtaatgccgcctcccatcccccagcatgtccccacccgcatgaaggcagccagagcttacccagaggatgctggggtggtcttgtgtggtcctgaaggccacagggcttgggagcaggatggaagggtccaagtaggcctctctggccatcctccctactgcccacgtggtgccccagggtgtcccgtggtgggggaaggccacgctcacagagtgggacggaggtgtgagtcactggccccgaccttggaatcttcagacaaaaggcctcagtctgctgagaccctcctcagctgtccccaacttcccttcatgcttccctccacaacctgggcatccccacagggcctgggaagttcactgactttttgaaaagagcctctcaagaacctgaagtagagagaaataaggccaaacgacactcccggcagggcaggcgtcattaagcagcgttaattaaatgcatcccctcaggctaattgggacccagg

SEQ ID NO: 382781 - DNA, 242 bp, Homo sapiens
gacgatggtgatggaccttaatctaacaaccatcactgcaatgcagtactattctttcaattttaccctctttgcaaacttcaaagcaggacaagagaccattgtatttccaaacaggtagatttctttcttttctttctttctttccttttttttttttttttttttttttttttttgttgagatagagtttcactgtctcaggctagagtgcagtggcacgatctcagctcactacagcc

SEQ ID NO: 382782 - DNA, 2629 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382783 - DNA, 838 bp, Homo sapiens
  misc_feature (811)..(811): n is a, c, g, or t
ctctattagtccatgaagacattatggtcatgggcccgtagaagcacatagtgtgtccttaacctaagtagggtaacccatatttattattttttataaagctaaaaatcataacactatcctgtttcacagcctctttctttatagttctttgtaaaatgggtatttatgggagccaaagggagattcatttatataaaatgagagccactgaggtgtttttctaccctaccaggaaaaggagccctatagctcagtcacttatttaaaggtagccaggagaagagaacctagggtaagaagacatcagaaggtctcaggacatataggggtcaggagaagaataggcatttagtgcatggagtgtcataaaagcacaggagaagcccaggctttactcaggtgttacagtgccttaggacctggaccaagagacctggtgacttgcacttttctagaagaggagggtacattagcctgccaacactatgttatttttttctgtcttgtggaaattttctcattctgactacagccccaaacagttcttatttgtggagtatgtcaaatatccctgcatgggtcctattatgtgatagtgtctgtgatatcagccctttgtgtaacactatgcaaggagagtcatgtcagggatgtcccctgtggttatcacttttcttttcagaccactgtgtgcagtgtgaagaagcgcgatttgcatttagcctgggagggttggattcgaggcaaggaaagatgttttgggttggtggcggccaacagtctactaagtccgtgaatatggggatcnggtatacgggtgtgatttgtgtgtggg

SEQ ID NO: 382784 - DNA, 2576 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382785 - DNA, 2611 bp, Homo sapiens
ctctattagtccatgaagacattatggtcatgggcccgtagaagcacatagtgtgtccttaacctaagtagggtaacccatatttattattttttataaagctaaaaatcataacactatcctgtttcacagcctctttctttatagttctttgtaaaatgggtatttatgggagccaaagggagattcatttatataaaatgagagccactgaggtgtttttctaccctaccaggaaaaggagccctatagctcagtcacttatttaaaggtagccaggagaagagaacctagggtaagaagacatcagaaggtctcaggacatataggggtcaggagaagaataggcatttagtgcatggagtgtcataaaagcacaggagaagcccaggctttactcaggtgttacagtgccttaggacctggaccaagagacctggtgacttgcacttttctagaagaggagggtacattagcctgccaacactatgttatttttttctgtcttgtggaaattttctcattctgactacagccccaaacagttcttatttgtggagtatgtcaaatatccctgcatgggtcctattatgtgatagtgtctgtgatatcagccctttgtgtaacactatgcaaggagagtcatgtcagggatgtcccctgtggttatcacttttcttttcagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382786 - DNA, 2796 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccagttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382787 - DNA, 2509 bp, Homo sapiens
ccggccccgcgcgccgcgcaggcgggggccgtggccaccaagcccgggcgcagtttctctccgcccacggcaggagcgaaggaaggccctggcgcgggcgggtaaactgcccaccgggcggcccacccgctgcgcccccggcccgcaagaggcagtcccaataggttggcccgcctggccgaagtccgcccggagcccgctcacctgtcagcccccactgccgacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382788 - DNA, 1799 bp, Homo sapiens
gaaatgagactgaacagaatgttgacagcttagttctgtcagacttcttggtatgagaatacaaactattgacctgtggccttatcatatcacacacagaatattattgttacttgagaaatcatatatgcactcctcaaacaacactcttccttcactcctccaacactctccctttcagtgcatccagggtccaacttcagatctgatcttgatctgtgccaacctagtataaattagaccttttccaaacttcatgcatagaccaaggggaagattattggcattctgtttacctccaccaaagcaaaattttacttatgtggtactgatttctctttctctcatttctccacttgatctttgtcacgactcacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382789 - DNA, 398 bp, Homo sapiens
ctcccaggttgacgccattctcctgcctcagcctcccgagtagctgggactacaggcacctgcaaccacgcctggctaattttttgtatttttagtagagacggggtttttcagtagagacggggtttcactgtgttagccaggatggtctcgatctcctgacctcgtgatccgcccgccttggcctcccaaagtgctgggattacaggcgtgagccaccgcgccgggcctgaaatgattcttgaagaaaatgggggtgcttttgaaggtttacgaatctgagtgacaaaagcaaacaatttcttccatgccccaggttttcctcagcaccaggagaggggcttggatcctgaatcgtgtaggggactacggatatcctgctgatgtgttgttctctt

SEQ ID NO: 382790 - DNA, 644 bp, Homo sapiens
attgagccaatagcaggcactcagaaggcagtaattgattgactgactgattgaattattgacaggccatggtttctgtcttttctactttaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgt

SEQ ID NO: 382791 - DNA, 1818 bp, Homo sapiens
  misc_feature (1581)..(1581): n is a, c, g, or t
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtatgttcccaggatgggagtgcagggatagtggccaaagcacaagaataaggactcttcacactggctaatagtaaagccacctctacccatacattaagaaaacccacagtggctgggcatggtggctcacgcctgtaatcccagcactntgggaggcggaggcgggtggatcacctgagctcaggagtttgagaccatcctggccaacacggtgaaaccccatctctactaaaaacacaaaattagccaggtgtggtggcacctgtctgtagtcccagctattcaggaggctgaggcaggagaatcacctgagccctggaggcagaggttgcagtgagctgagattgcaccactgcactccagcctgggcaacagactctgtctca

SEQ ID NO: 382792 - DNA, 2849 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382793 - DNA, 2795 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagtgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382794 - DNA, 2291 bp, Homo sapiens
gctgtaggaatacggcacgaggatctgttgagcgctctaggagaggcggtgagatccgacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccagttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaaatcactagg

SEQ ID NO: 382795 - DNA, 1126 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggtgagcagcttaccaggaaggaagacccttgacccatgcc

SEQ ID NO: 382796 - DNA, 375 bp, Homo sapiens
gcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaa

SEQ ID NO: 382797 - DNA, 645 bp, Homo sapiens
aaatttatttgcatgtagtttggtcactgtctagggagatgatgacagagtacgtgactaaattcttacaaataactagacaacttcttattactaataaatacaatttttgaaggtggtaaaacttcaaatataattaagtaatgactaatttatagctaatgttctatataaattgacattagggcgagtgcagtgggttatgcctgtaatcccagcaccttgggagcctgcggcaggcaaatcacttgagctctgaagtccaaaaccagcctgggcaatgtaaagaaaccctgtctctataaaaaaattagctgggtgtggtggcatgcgcctatagtcctagctactcagaaggctgagggaggaggatcacctgagcctcacaggctgaggctgcagtgtgccaagatcattgcgcttcagccttggcagcggggtaagaccctgtctcaaaaacaaagtagaataaataaacaaattgacattagcgatttgttcaataaaattattaatttggaacaactttctattgctgtttgacatatatatataatctttgtaaaagttaaagcattttaaaattaattatttaaattactaatgtgttatttacacatttttggaaaaaatcctaaaatcttg

SEQ ID NO: 382798 - DNA, 3116 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382799 - DNA, 1008 bp, Homo sapiens
  misc_feature (790)..(790): n is a, c, g, or t
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaagtaacttggggaaaagtngttacaacatcactgctctaggttccggaagggaaacatcgagggcaaccggggatcgcgaggactactgaacaccagacaatacaggtttacacgacgagacctcgtgggggcactcccactaagatagtctgtcgtcacttgcacagacaataataacgctggagcaccatcgacgcccagcgccctacaccacgccgcaccagcgcagggcacag

SEQ ID NO: 382800 - DNA, 354 bp, Homo sapiens
aacagtttaaaagaaatttagattttatttcctagattattttctttactaaacaaatataaaagctttatttttttgaactgttaaaagtatcaccctgtttcagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactcttgaagaagtgactcaacgtcacgaaaagcgaaaaaattgccggtctgcctcccaacc

SEQ ID NO: 382801 - DNA, 290 bp, Homo sapiens
cgtgtcatggttagctgttgatgtagttcatggaattaaataagttactttaggttaggtgaattgtttttatcttgtgtcctatactacaactgtcaggtgatgactacatacttaatcaaaaagaatgattcatatgtaaataatttttattttcttatcactttacttttaggtaactattataacatcaaaaatctccggaatgaggaaagtgttcttctttttactcagataaaaagatgaaagatcaaccaacctttacacgtctaaccttacacgggtaccga

SEQ ID NO: 382802 - DNA, 3062 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaatatcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382803 - DNA, 2486 bp, Homo sapiens
aacatttgtgatacagatgttattccatctagtgcccaaaagtgtaagtctctctctttgggcactagatggaattacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382804 - DNA, 3368 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgtaaaaaaaaaaaaaaaaaaaaaaaaaaaaaaaaaaaaaaaaaaaaaaaaaaaaaaaaaaaaaaaaaaaaaaaaaaaaacttaaaaacaagttcctcgccccacaattggaaaagaggagccaagaatttgcacaaatttgcctaacaaggctttcactctttttagctaacccacctttcaacaacttggaacttgaccccaagcaacagcttgcttgatcccccacacatggccattgatcacactgttttcc

SEQ ID NO: 382805 - DNA, 2236 bp, Homo sapiens
aacagtttaaaagaaatttagattttatttcctagattattttctttactaaacaaatataaaagctttatttttttgaactgttaaaagtatcaccctgtttcagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382806 - DNA, 2747 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggtaaaacttatttatgttataatatctgtcaataaaaaatttgtttactatgtgccagacactgcactacatgtttatatacattaccttacttaatcatcacccccccaaattttgataataggatttaaattcatttttgtctgattaatgtagagatgctgatattttctctttggtagctgaatgttgttattcctgtatcatctgacaagatttccaattgcataatataaagcgttagattagaacgtgagaaaattgtaactggtaaaggtaaagtagttttcattatttttcc

SEQ ID NO: 382807 - DNA, 2494 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcaggtaaactattgttttttttctgtcttgatttttatggcattatgaatatggagtaaggagtgctatgttttgtttacattgtcactgatggcgagtgtatattgagtacctacctcttaagacccttagttagagattaataagaccctgtacctaagtgagacagaaagaaaatgagtgacagttttttaagtagaacataatgaa

SEQ ID NO: 382808 - DNA, 940 bp, Homo sapiens
ttttaaaagcctccactgatgactgttgatttcaggggagcaataggaccatctaatcatgtttcatcatctaatcctgttttatcagcctctgatttagggtggtagagatataatgaaattggttggtatttgtgttattttaactattagctgcagacatatattctttggtactttgaaaggaaatgtgccatattaaatttaaggagttttgtttcaagattttgtctttcccatgtatattttactttttttgttaaatttcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382809 - DNA, 1007 bp, Homo sapiens
ttttaaaagcctccactgatgactgttgatttcaggggagcaataggaccatctaatcatgtttcatcatctaatcctgttttatcagcctctgatttagggtggtagagatataatgaaattggttggtatttgtgttattttaactattagctgcagacatatattctttggtactttgaaaggaaatgtgccatattaaatttaaggagttttgtttcaagattttgtctttcccatgtatattttactttttttgttaaatttcaggaggattcgtgattagtggagtactatctccagacacaatatcgtctaaaaggaaggcaaaagaaaatattggaaaagtcaacaaaaaatctaataagaaaaggatctgtcttgataacgatgaaagaagtatgaacttatttctgaaagtaacttttagattttattttaaataggagtactttgagaagaagctctttgcaaaatatgaaatttacttccatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382810 - DNA, 1531 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggtaacattttatttaaataatgttaacgcactttaaaaattttactttttgtattaaaaaatggtaattcaatcttgttatattattttacactaaggaaggaggaatattaacatgttatgagaaagtatacatttagcatatattcagtttgtaataattaaggaagggcttaaagtgtacttcagagaagtttagaggttaacttttctatagtctggaataatgtgttttctctctgataatatttgattgcttcctaagagaaacaatttgtattttctcaatattttttgtaattgcaagtgtagatgtgtatcaggtcacttcaagggtagcagagcataagtattattgaggatgctatgctttgtggacagctggtttctctttcttgaccttacctttggcctttaggaaacaaagtggattcaaggtcttttgcatttggagatctctgtaatgagtgtaatttctatttagagtattgtatgattactggagccaaggagttaagtatattctaagactttgatattcaaagtttggtctgtcacagtgctctaagattgccctgagaaccattgcctagctatacatttcattgatgtatactttagccattattttctctttcatgtttttctattgataaatacaaaagttaattttcctgagcagtttatcttatgtatttggaatgcacaaatcagcatttatgtcttaaataaatgcctagtacagaattttaaattggt

SEQ ID NO: 382811 - DNA, 374 bp, Homo sapiens
ttctaatcttaatgactttgagttttctgaaaactatttctgattaaattattgcagaatttttaaaaagcctgcttgattctcttattattcttttaattgacaaatatctttatataattttcttctagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaata

SEQ ID NO: 382812 - DNA, 3323 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagacctgattaatatgtctactcattaaaaaacatcttttccaaataaaaat

SEQ ID NO: 382813 - DNA, 3089 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382814 - DNA, 3309 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagaacactggagtcacctaccactcctttttccccccc

SEQ ID NO: 382815 - DNA, 1391 bp, Homo sapiens
ctggacaaacttactaactttaggttatcattgaatccttcaggtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttgtgta

SEQ ID NO: 382816 - DNA, 2449 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcagatcctgaagctccattcagttgtgacat

SEQ ID NO: 382817 - DNA, 1658 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagccagaaaggtagcactgaaaagattgggggattcttaaaggagcgcttttcagt

SEQ ID NO: 382818 - DNA, 644 bp, Homo sapiens
cactcaggcgtaatccatagggtttgagtgcaggactccccaaggacccaggctggggatggtggcgggcgtgatgatgccgttgacgagctgctggatgatcccttctagcgtggggaggccttcgtgccggccggtggcccgccgcgtggggaggcggaggcggggctgccgggcgcagtacggggccgggactgatgctctgtctcccacggtctctcagggtccttgctgccgtcagcctgcgccccaggagagaacgtggggatctcgaagctgtcgtcaaagatgccgaaagcaaactgtccgtagccctgcggcagcgtgaacaggtgctggtccgcgttctccaacggcggccggctctggtccgtgggggcagtggaaggggcagagctgttttctgtgctcctggtctcttcaggaagctcctcgataaaatcagacgcacatcttgggcagatataatccgataggcgcgggacggtgtccagggagcagcagtggcagaagaaccgtcctagctgctgcgacgcctcggccctggccaccgccccctactctgcgccgcccgccccccgcgaggcgccaaccgccggccatttgctgctccctcgctgatcgacgcccaaaccttttatata

SEQ ID NO: 382819 - DNA, 838 bp, Homo sapiens
actggaggaatcacatacccttcaagcacaaggcatgcttcagggctgaaaacaggggcaatattaaagtctgcataaggagcatttagctaccacgacttctcccaaccctgagcaaccacctcgccttagcctcaagagaaatcaggtgatgtatattctggaaaggttgaggtcctaggctctgaaaatctcagtagagctgaggacagggtggaggtgagaagccacaatgaaaactgggggcttcagtgtacactggtatgctgaacagtgagatttctctatcctccactcctacctgcatcctctcagctctcactctcaagatatggtttaggcaagaactactctccaagcaggaactactctctggaaaagctgaccagcccaagagaacatttctgcagagaatgacaaatgaggatccccatcctatcatcccaggctgaagtctatcagttctcaaactcctctttccaaccacccaacctgacataccatagcagagagctctaaatatttgaggaaaactcccacatatggtcagcaaaacaaacagggaaggggaaaactcagagaaaaagaaaaaataggaatacagggacaatgcaggaaggataataaaactttaaacatttaaagagaaagaaagatacacggtattacagacacaaataaaatctcaaaaatttatttctatgcttcctttctcaggaagttactggactcagtactcccacaaaatgagggtctaggctgggctcagcggcttacacctgtaatcccagtacttaggaaggcagaggcaggatagtctgggcaacacagcaaggct

SEQ ID NO: 382820 - DNA, 403 bp, Homo sapiens
caaatgcagtagtcaaaacaaaatctcattgggcagagaaagccagttaacttgttaaatacctagtaggcggttcatttttaaaattgatacataatatacctatttatgggatatatgtgatattttgatacatgcatatctatgtgtaattatcaagtcagggtggttaagctactcattacctcaaacatttaccatttctttgtgttgggaacatttcaaatctactcttctggctattttgaaatatacaataaattattgttaactatagtcactctgctgtgctatcaacactagaatttattgcttctaactgtatgtttgtacccattaaccaagctctcttcatcctccccacacccaaccattcccagcctctggtaaccatcattctata

SEQ ID NO: 382821 - DNA, 426 bp, Homo sapiens
gactggataagtgcaatcttaatagtcattcagtggaataatatttggcagtaaaaaggaatgagggaagtactgatacatgctgcaacgtgcataaatcttgaaaacattatgctcagttaagccagtcacaaaagggcacacattgtactattccatttgtatgacacatccagaataggcaaatctatagagagaaagattagcggttgccaggggctagggttggaggtggagaatacaaagtgagaactaatagatacaagtttctttttggaatgattaaaatgttctagaattagtggtgatgattgtactactttgtgaatatattaaaaattttaagacagtcttatggcatatggaattacatgtccatagtgattttaaaaattaaatattgggcatgcatatctaaagacagta

SEQ ID NO: 382822 - DNA, 254 bp, Homo sapiens
agtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttgggggg

SEQ ID NO: 382823 - DNA, 913 bp, Homo sapiens
agaggggaggggaggggaagaggggaggggaggggaggggaggcaaagagaggggaggtgagggaaagagaggagaggggaggggaagagaggggagggaagggcagggcagggcagagcccggcaggcagccctcagaggaggggcgcaggccccagcccaaggcctcccgcgcctgcccaggtcccggcctccatcgtccagggctctggggctcccaggggagacacccacgctcggccaagcccagggttccagaagcccaggggtggcggcagccgggctcagcctatggccaggctcgcattcagacatgcgccagcctcggtcggctctctccgggagacactaagatctcctcactgactttggtgttccttggtctcaccagcgcgtcctagctgtgccgagctcacacccaccctgtttggtgtaagccacaggtccacaacgttcatcagctctggaaatccctcaacaattgtgtccagtttcaccacgaattccttctccatatcctcaccattttcttttaccccctcatcaaattactcccttccgtctaatctgctgattaactcattcattttatcttaaattattatgttaacatatccaggccaggcacggtggctcacgcctgtaatcccagcactttgggaagccgaggagggcggatcaccagctcaggagatccagatcatcctggctaacacggtgaaaccccgtctctactaaaaaatacagaaattagctgggcttggtggcgggcacctgtagtaccagctactcgggaggctgaggcaggagaatggcgtgaacctgggaggcaaagcttgcagtgagccaagatcacgccactgcactctagcttgggcgaaagagcgaggctccgtctcaaaaaaaaaaaaaa

SEQ ID NO: 382824 - DNA, 384 bp, Homo sapiens
tgaaaagtgcgccctacgaaaggacggtcgacttcggcggggcccaggtgagaaaggcccacctgtgtcctggttgagggtctccagggttctttggggcccgaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382825 - DNA, 734 bp, Homo sapiens
tgaaaagtgcgccctacgaaaggacggtcgacttcggcggggcccaggtgagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatgtgttctggaccatcaatggagcctacaattcaaaattcagatattgtctttgcagaaaatcttagtcgacatttttatggtatccaaagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382826 - DNA, 928 bp, Homo sapiens
tgaaaagtgcgccctacgaaaggacggtcgacttcggcggggcccaggtgagaaaggcccacctgtgtcctggttgagggtctccagggttctttggggcccgaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcaaaaagacgcaagggctaacgacgaacaagacgcaaacaacagtggacaggagcagcacacatacggagccaccgcgagaaaaacgtctctaaaaaacacaatcagaagagtgcggcccgagggcgcccccagaggcgaaaaggcagacaaagtggggcccaaaacagcggtgtgccccagaggaggaaagaaccgggggccacacaggaaccacacaaaagagtgcagagggataatacccgaccaccaacagaaagaaaaaaaagacacgccggcgcgggggtcgggaggacaaaacacacccgggagcagggccgtctgtctgttaggtagaagcacaaaatgcatcgtcccaggcaagtaggagggagacactcacgggaagggggacgaccaatcactgacacggggtgaggcaatctcatgtataactatcagccaaacggggaggggcgacttaacaaagcagaggggagcagcgaccacagcgacaaaaatacaccaagacaatttgtaagccccgcgcgtagcgcgggggatgggc

SEQ ID NO: 382827 - DNA, 464 bp, Homo sapiens
ctttgatatttagtaaaagttattgtgcaagaaataaaagcaaaaatgcaatattaggatttgtatctattctataaaagagagccttaggacatttctccctacctctgaatgacatgctttttaattatagtacccaaattaggttttatctttaagaggctgcatttcttctctaattctaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382828 - DNA, 643 bp, Homo sapiens
tgaaaagtgcgccctacgaaaggacggtcgacttcggcggggcccaggtgagaaaggcccacctgtgtcctggttgagggtctccagggttctttggggcccgaggtgaagcgacttccagtcatttggaaaggatgggatgaaaaggaaccttggtgataattttgatgtctgcaagatttagtaccagtgtaatgggattatcggtaacaccttcactgcagaaaaagccacctggcgctataactggcagcaactgagaactaatcctttcccatctcttggatgtcattcatgaagctcaaagctatttctgccctgctaactgtgattaattttataaacaacaacaacaaaaaatcaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382829 - DNA, 844 bp, Homo sapiens
atgtagaaaattttattcttgattgatgagtaaggagaaagtgtttatctggcatagagaaaagggacagatagcaaaagggaatatgatgatactataacattactttcactaattgtcttcaacctcattttgattttacagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcagttttagttgtttttaattgttaaatgtaaagaatattcaacacacattctgccaagttctgttagttcaaaatatatggataaaaatgtaacccacaaaagtcatctaaattttatgatacaaaaatattgtgggagggggaacctggatgactacctcacttttgaattcttgttcttataggtataatgaaactaatctattcttcttaaatatacctcatactttagcagctacatttacaagtcagagtagtaactattcgtatttataagttcaacctgacaatgccaggtttgataaaaagctgctagtctacatgctcagcccactcatttgaaattaagtaaaaatgtttctaaaggatcccttaaagttctttaaatgagttctgacttttactgtacacaaaatattaaatacatagaaaaatgcatctttaaggcatatgccatctgtagttggctatagtccaataatactttataaaagttcatttcagcatagcagcagtgcaatggccctgtcttc

SEQ ID NO: 382830 - DNA, 481 bp, Homo sapiens
tctcaagaaaagaaaagaaaaaaaaagatgctgtttgctttccttattttgaagactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382831 - DNA, 544 bp, Homo sapiens
  misc_feature (527)..(527): n is a, c, g, or t
  misc_feature (530)..(530): n is a, c, g, or t
tgaaaagtgcgccctacgaaaggacggtcgacttcggcggggcccaggtgagaaaggcccacctgtgtcctggttgagggtctccagggttctttggggcccgaggccaatggtggcagagtctacatagaactatgcttcgtggtgttctggggaaaacctttcgacttgttggctatactattcaatatggctgtatagctcattgtgcttttgaatacgttggtggtgttgtcatggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcaaaagacaanaancacaacaaacacaa

SEQ ID NO: 382832 - DNA, 904 bp, Homo sapiens
  misc_feature (887)..(887): n is a, c, g, or t
  misc_feature (890)..(890): n is a, c, g, or t
tgaaaagtgcgccctacgaaaggacggtcgacttcggcggggcccaggtgagaaaggcccacctgtgtcctggttgagggtctccagggttctttggggcccgaggtgaagcgacttccagtcatttggaaaggatgggatgaaaaggaaccttggtgataattttgatgtctgcaagatttagtaccagtgtaatgggattatcggtaacaccttcactgcagaaaaagccacctggcgctataactggcagcaactgagaactaatcctttcccatctcttggatgtcattcatgaagctcaaagctatttctgccctgctaactgtgattaattttataaacaacaacaacaaaaaatcaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcaaaaaaaaaaaaaaaaaatcggggatttatgtggggggcggaaaaagggggcactggaagaggccaggggtccttaggggggtttccctggacccagctttctggtccaagggggaaacctgcggggccccctaaagggaggcgataattcgataggcgggtaacgtaaagaggcgcacacaaacccaaacaaaacagacacggggggaggcaacacaacaaaagcgcgcgcaaacaaagacaanaancacaacaaacacaa

SEQ ID NO: 382833 - DNA, 727 bp, Homo sapiens
tgaaaagtgcgccctacgaaaggacggtcgacttcggcggggcccaggtgagaaaggcccacctgtgtcctggttgagggtctccagggttctttggggcccgaggtgaagcgacttccagtcatttggaaaggatgggatgaaaaggaaccttggtgataattttgatgtctgcaagatttagtaccagtgtaatgggattatcggtaacaccttcactgcagaaaaagccacctggcgctataactggcagcaactgagaactaatcctttcccatctcttggatgtcattcatgaagctcaaagctatttctgccctgctaactgtgattaattttataaacaacaacaacaaaaaatcaggtcatcaaggcaaagaatatgctctttattatttataatatgtaaccttatgttaagctatatgacttaaaattatgcaagacatatacaaactaagctatatgattcaaaatttattaagctattgaaatagaaaagttgatcaatgatgtcttggtttttttaattgaatggcaaattatttactattggtaacaattcatatttcagatcaaatattaatttaaatacttttatattcttttggctatagagccactatgaaattaatcaaaatgtctagctgtaaggaattgaaataatatgtttcgtcatatgttttacctgtttttgactgcttcagttgctactgatgaaatgttt

SEQ ID NO: 382834 - DNA, 312 bp, Homo sapiens
atgtagaaaattttattcttgattgatgagtaaggagaaagtgtttatctggcatagagaaaagggacagatagcaaaagggaatatgatgatactataacattactttcactaattgtcttcaacctcattttgattttacagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382835 - DNA, 814 bp, Homo sapiens
tgaaaagtgcgccctacgaaaggacggtcgacttcggcggggcccaggtgagaaaggcccacctgtgtcctggttgagggtctccagggttctttggggcccgaggtaggtaatatcacgtaacgttcttctccttttgagtgccttcattcacattgagttaaagaaaaggaatttcagacctgaacaatcaggtggacaacttcttgtgactttgggtattctgaaattactcatcttgactctactgtgcctggatgtagctgtgtgttttgccaatggtggcagagtctacatagaactatgcttcgtggtgttctggggaaaacctttcgacttgttggctatactattcaatatggctgtatagctcattgtgcttttgaatacgttggtggtgttgtcatgaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382836 - DNA, 893 bp, Homo sapiens
tgaaaagtgcgccctacgaaaggacggtcgacttcggcggggcccaggtgagaaaggcccacctgtgtcctggttgagggtctccagggttctttggggcccgaggtaggtaatatcacgtaacgttcttctccttttgagtgccttcattcacattgagttaaagaaaaggaatttcagacctgaacaatcaggtggacaacttcttgtgactttgggtattctgaaattactcatcttgactctactgtgcctggatgtagctgtgtgttttgccaatggtggcagagtctacatagaactatgcttcgtggtgttctggggaaaacctttcgacttgttggctatactattcaatatggctgtatagctcattgtgcttttgaatacgttggtggtgttgtcatgaggtgacattgtgattgcaaaaagcccaagtgatccaaaatcaaatatttgtaaaagagtaattggtttggaaggagacaaaatcctcaccactagtccatcagatttctttaaaagccatagttatcatttcagataagagatactcaacctgcaacttatagaggtggatcagcaaagatgcctgctttaattttaaaagatctgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382837 - DNA, 916 bp, Homo sapiens
tgaaaagtgcgccctacgaaaggacggtcgacttcggcggggcccaggtgagaaaggcccacctgtgtcctggttgagggtctccagggttctttggggcccgaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattcagttttagttgtttttaattgttaaatgtaaagaatattcaacacacattctgccaagttctgttagttcaaaatatatggataaaaatgtaacccacaaaagtcatctaaattttatgatacaaaaatattgtgggagggggaacctggatgactacctcacttttgaattcttgttcttataggtataatgaaactaatctattcttcttaaatatacctcatactttagcagctacatttacaagtcagagtagtaactattcgtatttataagttcaacctgacaatgccaggtttgataaaaagctgctagtctacatgctcagcccactcatttgaaattaagtaaaaatgtttctaaaggatcccttaaagttctttaaatgagttctgacttttactgtacacaaaatattaaatacatagaaaaatgcatctttaaggcatatgccatctgtagttggctatagtccaataatactttataaaagttcatttcagcatagcagcagtgcaatggccctgtcttc

SEQ ID NO: 382838 - DNA, 687 bp, Homo sapiens
tgaaaagtgcgccctacgaaaggacggtcgacttcggcggggcccaggtgagaaaggcccacctgtgtcctggttgagggtctccagggttctttggggcccgaggtaggtaatatcacgtaacgttcttctccttttgagtgccttcattcacattgagttaaagaaaaggaatttcagacctgaacaatcaggtggacaacttcttgtgactttgggtattctgaaattactcatcttgactctactgtgcctggatgtagctgtgtgttttgccaatggtggcagagtctacatagaactatgcttcgtggtgttctggggaaaacctttcgacttgttggctatactattcaatatggctgtatagctcattgtgcttttgaatacgttggtggtgttgtcatggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382839 - DNA, 459 bp, Homo sapiens
tctttctgtttgtttaaatgtcatttcccttagctaaaagtcaaccatctggtcttctattaccacttgtattataaacagaaaaaagtacttctctgtagagagaggaatcatcagattgaaagggcttgtgtattataagctgctgatatactaaatccttatgtcatttaaatagaagaactgcctaataatgtcacttattacaactagagtatctaaacaagcgacttgttttttgcagactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgacgtgactttttcattctatagctaacacaattctgaagataaatttcactcattgtttacaag

SEQ ID NO: 382840 - DNA, 511 bp, Homo sapiens
tgaaaagtgcgccctacgaaaggacggtcgacttcggcggggcccaggtgagaaaggcccacctgtgtcctggttgagggtctccagggttctttggggcccgagaggtgacattgtgattgcaaaaagcccaagtgatccaaaatcaaatatttgtaaaagagtaattggtttggaaggagacaaaatcctcaccactagtccatcagatttctttaaaagccatagttatgtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgtctccttttcatgtgaatttattactcccgttgaaaccgtgtacttaccaataaactatttgctattca

SEQ ID NO: 382841 - DNA, 568 bp, Homo sapiens
cagtgtggatggaactattttctaaaatttgcggtattcataggcttttgtttttggcagttctttgaaaacgatttggagattgtaaaataatagtcaaagactattctcatgtttctcataagtatgaggtgatggagagtgggatttgctttaatttgtgacattaattggggtatggggagttttaacattgattacagtttttcagtgatatctattgcacttaaatctacctttcccgtcatctatattttattcatataattctcaggtaatttttagcattgtatttcacttcaaagctgaaatatgattgggagaaacttgatcctttgatgttaaaccaaggtacctttgccaaggctgtgaaattctgtatgattcattcaagaacacttgaaggccagtgcacaaaaagatgtcttaatctcctgaacatcctagtgtccaggctcaactctggcaccaagaacagagttctacacaactttttcccagcatcaagaaaatccttgttccggctttaccgagtttacgctgggagcagtcagcttctgggtgacag

SEQ ID NO: 382842 - DNA, 422 bp, Homo sapiens
atggaagcagctaggcatgaacaccaattaatgctaatgaggcaagatctaatgaggcatcaagaagaactcagatgcttggaagaactcagaaatcaagagttgcagagggtggagccaagatggccgaataggaacagctccattctacagctcccagcatgagcgacgcagaagatgaatgatttctgcatttccaactgaggtacctttgccaaggctgtgaaattctgtatgattcattcaagaacacttgaaggccagtgcacaaaaagatgtcttaatctcctgaacatcctagtgtccaggctcaactctggcaccaagaacagagttctacacaactttttcccagcatcaagaaaatccttgttccggctttaccgagtttacgctgggagcagtcagcttctgggtgacag

SEQ ID NO: 382843 - DNA, 395 bp, Homo sapiens
caccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcatggaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatca

SEQ ID NO: 382844 - DNA, 160 bp, Homo sapiens
aaggttcggaaggaaattttaactaattgttctccctccaatgtgtgaaggggagcccctggaagtcagggtgctctttgggggataccataaaatactagtcagttgggcatggggaacaatcttttttttttttttttttttaatttttttgagacgg

SEQ ID NO: 382845 - DNA, 374 bp, Homo sapiens
caagcaccatgcacccaggctcagccccaccagacgtggaaacgagaattagtccagatgccctaaacgtgtgacgtttttgtccaccagcacagttaaaagctccagctctgaaaaggacgcccaactgcgccactggctaattgtttgaccctaatggaagcctgaatttcctcaatctgcaaaatgatatctgcctgatagagctcttgaaaggattcagtgaggaactgcagattaaaggtacatggcttcagagaaaacacttgatatgacagctgttactgtatcagtagtagtagtagctcagtagtatctggttagcctgttggaagccccaacttaccccatctgaacaatgggctccaggcctc

SEQ ID NO: 382846 - DNA, 244 bp, Homo sapiens
aacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggata

SEQ ID NO: 382847 - DNA, 998 bp, Homo sapiens
gccttcagggccgtgccccatgctgctcctctttttgtccccacatccagcagttttccattaaaccactgtaggtcctctcagaacttactagagtcatcgtgtcatcgtctcccattactccaggagagcagggccctggtggcacttgaggcaagaccccaagctgatggcactcgaccacatagtgggagtgaattttaaagaaaatccccctcaaagcctctgctggtgtagaaggcagatagtctaggccggggtagggccagtgagtgggagccagggaaggaggcttgggtgtcatgagactgggtttacatttacagatgacaaaaccaagacccagtgagggggaggatgtgtgcaggccacaggacaagtctgagcagaaccatggccacgcccaacgttcctccactagcattccctcatgaaagatcactttttccaggccaaggaccagaaaaggaccaggctttaggaagagggccgaggtgcatggaaagcagtgctggtgaggagagggttgagtaactggattttgactgtttcttcgcatttggttctcactaatgaaatcttgtcagacgtgcccctgctgctggattgggtgggggtgggacagaagcatgtgtggtcaaaggcaagtttatttgcagtttgggggttgaatgcagtggatttcaaactggatattttgaggagttccatgagggtccaccaaggtataccagggtcctcgccctgatgcaaccagagtagttcttcatcgactttatacagtgggactctgaagaaaagaaaaaggaaaaccccatagcttagtgggaatccgggcgaattaaaacacaggatgaagtgcttgttctctttggctcttggagcataatgtatgtccttttcctacttggtttgcgtgtaataacatcattggtatatttcaaaatatgaagctcctggtgctggataataaatgttttcccagtttttcaacctct

SEQ ID NO: 382848 - DNA, 961 bp, Homo sapiens
  misc_feature (942)..(942): n is a, c, g, or t
  misc_feature (945)..(946): n is a, c, g, or t
gccttcagggccgtgccccatgctgctcctctttttgtccccacatccagcagttttccattaaaccactgtaggtcctctcagaacttactagagtcatcgtgtcatcgtctcccattactccaggagagcagggccctggtggcacttgaggcaagaccccaagctgatggcactcgaccacatagtgggagtgaattttaaagaaaatccccctcaaagcctctgctggtgtagaaggcagatagtctaggccggggtagggccagtgagtgggagccagggaaggaggcttgggtgtcatgagactgggtttacatttacagatgacaaaaccaagacccagtgagggggaggatgtgtgcaggccacaggacaagtctgagcagaaccatggccacgcccaacgttcctccactagcattccctcatgaaagatcactttttccaggccaaggaccagaaaaggaccaggctttaggaagagggccgaggtgcatggaaagcagtgctggtgaggagagggttgagtaactggattttgactgtttcttcgcatttggttctcactaatgaaatcttgtcagacgtgcccctgctgctggattgggtgggggtgggacagaagcatgtgtggtcaaaggcaagtttatttgcagtttgggggttgaatgcagtggatttcaaactggatattttgaggagttccatgagggtccaccaaggtataccagggtcctcgccctgatgcaaccagagtagttcttcatcgactttatacagtgggactctgaagaaaagaaaaaggaaaaccccatagcttagtgggaatccgggcgaattaaaacacaggatgaagtgcttgttctctttggctcttggagcataatgtatgtccttttcctacttggcagcagatatggggatcctatagagtcgggntgnnggcaaggggttcaaa

SEQ ID NO: 382849 - DNA, 735 bp, Homo sapiens
gaaatcatgcacaaaactggccttaggagaacagtgtctatgttgtgctgccctatcaagtaccggaggaaacgccactacagtctcaccagtttcacttgacgtgcccccccaactctcccagaaagcccaacacttcagccacagtccatgtgtcgagaaacagagtcactacattattcttttctgagtcaagccttatgagggtgcctggtaggcagagtctaattacatgcctacatcttagctgcaagagaggctgggaatttgtgttttgatatctacaataggaagacagaactcatgatgtgggattttcccaaatagtgaaatatttttcaaaagatgggctgttaagaatataacagatacccagtacacaacccagatctatttcagtatttgttttttgttgttgttgttttggagacagagtctcgctctatcccccaggctggatggagtgcagcggcacaatctcggctcactgcaacctccacctcccatgttcaagtgattctcatgcctcagcctcctgagtagctgggattacaggcacctgccaccacatctggctaatttttctatttttagtagcgatggggtttcgccatgttggcctggctggtcttgaactcctgacctcaggtgatctgtgcacctcagcctcccaaagtgctaggattacaggcatgagtcactgcacctggcatatattagtatttgaaatttggt

SEQ ID NO: 382850 - DNA, 442 bp, Homo sapiens
aaaaaatgatgaatttttaaataattttaaaagacaacttgtaagcatactagtctcatttatgaccattaagtaagcaatgaacaaataaaattagaaaagcttattatttcaccttaaatgtcttatagtcaatgtatatatttcaggaatattgcaccaatctcactttcactaaatttgaactaaggcataaaggacatctaaaatttgaatgttgtatggttaattaacatttaataaacttattttctttgtttaaatgtctttgaaaatcaaatgtctcatgctgtttttcctcatcaatgtaatcccagtagtcctaggaatgattttgttgaattgtttgacaaaacctaacttggctgcttgtaatttatagttgttcacccccgtcactttgcagtttttccctactaaaaaatttagatttctgtgaagc

SEQ ID NO: 382851 - DNA, 452 bp, Homo sapiens
ctaaagatggacatactttaggaggaatatgtggctttcctcagctctttctttctttactcaaggctgtccagtgggagcagaactagcttatgacttgcagtattgtgttgcagtgtaattttataaacattctggaactatttcttctagagtaatttatgatatttcatgtcctgtgcagaaaaagaaatccacagctgggcaattacatactggttgtactgtatgtttttaacaggcatctttcctaacataaaatgcaagaatactagtcttgtttttttgtctcctgattttgtaaataagcaaaacaaaattgccaaaaagcttattccaggggaaaaatatgtgttaaaaattgatagattatcacccttccacgtggagctttctattgttatccatccatgtgattaaaaaaaatctttattgtagttttactagagaat

SEQ ID NO: 382852 - DNA, 322 bp, Homo sapiens
gatggcgttattggcttacccactactttaatactgttttggtacaactaaaatttttgcaatggagtacacgatgaaattgcttcatgctaaccttccccctcaccaaataatggtgactgctaaaagtccttacaactgcagactaggtaattgaataatttgtatatcaaattaaggtccaaatgatgcttttaatagcacaattactcataataaggaaaaggtcagcattcactagtaattatctattctctataatttttaaaacatgaaaaaaaaaatgctgtgaccagcatatccaaaggggaaaaggcactgt

SEQ ID NO: 382853 - DNA, 432 bp, Homo sapiens
tttttttttaaagttttttctcagtgaaaatatacacattctataataaaaaagagcatttatcttaaatataaataaaatactctacaaattattaattactagtattatcttaacccagtaaaggctctattgctcttactttctgtgttgaataaagtattatagtcactacttagaaactccatgttttatctatgactgatactgcttcattcagctactgagcaaacaggcacagtgtcctgttccccatttagatcagtggtctccaacctttctgacaccagggaccagttttatggaaggcaatttttccacggatgggagggtaggggatagttttaggaagacaagcacattacatttattatggcactttatttgtattattattacattgtattatataatgaaataatcctatagctc

SEQ ID NO: 382854 - DNA, 464 bp, Homo sapiens
tacttttctggttaccagttcaaaaagaaaaaaaaatttatgacattatggcttaaatttacctttttcatgaagcaccacttcacgattatgaagggttgaaaatagcccttttaactcccgtgctgtttactgtccctgccaaacattagacatttactgcttatgtagttaattgtctttattgtataccatcaagattaggaaacatgggccgggcccggcagatcacgaggtcaggagatcgagaccatcctggctaacacggtgaaactccgtctctactaaaaatacaaaaaatttagctgggcgaggtggtgggtgcctgtagtcccagctactctggaggctgaggcaggagaatggtgtgaacccgggaggtggagcttgcagtgagctgagattgtatcactgcactccagcctgggtgacagagtgagaatctgtccccccagcccccccaa

SEQ ID NO: 382855 - DNA, 395 bp, Homo sapiens
gcctgtaatctcaattatttgggaggctgaagcgggtagattacttgatgtcagcagttcaacatcagcttggcgaacatggtgaaataccgtctctactcgcttcagcctcccaaagtgctgggtcacaggcatgagccatcccacgaagcctatcattttttccttttattttatttttttttgagatggagcctgggcaacaagagggaaactctgtctcaaagaaaaaaaaaaaagaaacgaaaatactatgtaggaaatatgtagtaaaaacatgcacaggaatgacaaatgccaaattcaaaaatgttgtgacctctgtggagaaaaggtgaggaatgagttaatgtgtgaatgtatgggtacatgctttctattaacttagtaggaga

SEQ ID NO: 382856 - DNA, 460 bp, Homo sapiens
taacaatatatggtaatactttaaactctgaatggaaaatctcagcctcacttcataggattctaattttcatgtcactaaaaacattatgctaaaaagttaaataaggtgattagaaatccactttgcagaccataacctctttacattaatgggaaaaaagaaagcattaaatgagaagaaagaaaaggcaagttgcagattaatatgtattttatgaacccatatgtatttttaaagatgagagaatatcttcctgatcgttaagtagggaagagtcttcagccagcactgattataaaggaatagatcaaacacataccctatgacccagcaattctccttgtagctaactatgtttacaaatagacataaatagacacgggaactaagagacatgtacaaggctgttcacagcagcataactcataatagcaaaaaagtagaaacccagatattc

SEQ ID NO: 382857 - DNA, 287 bp, Homo sapiens
ctacttatactcgatgtgggaaaaatgggaaatgttagggggttcataaacagaaatccttgcaggaagccgggtgtgacagcagacacctataatcccagctacttgggagactgagctgagaggcccacttgaggccaggaatttaaggaccagcctgggcaacatagaccttatctctaaaacaaaaaaaaatccttgcaagaagagagaataattgcttcccatttggaaatgatatagggacttttgaattagatctatcttgacaaagttttctaggccat

SEQ ID NO: 382858 - DNA, 479 bp, Homo sapiens
gtaccctaattgtaaaagaagtgtggtcctattttttttcagtgacaattttacttctgtttacttctgtctactatagtaaccatgtaacacaatttgttcagggtccttttatagctgctgggaacctttgccaagaaagttgcaccaaaatataagtatagacagggaagctaggtttaggtatattagccattggtttgttatgggttcaaataaggataggtagttgaaaattatttgaatgtctgtattctgtttagaattggagtgattttgaacatgataatttaatttgaactaggtcatttctgatgttaataataagttgtcttctctaggtttctgcattctccttattaattcttgagcttcttaatttctaggatgtgttttctccctgtgtccttccctaatcttacacctgttgctcctcaatttgtgtgtatgcacatgtacatgtaaggatttttctgatg

SEQ ID NO: 382859 - DNA, 411 bp, Homo sapiens
atgttttcactaacacaacacatgagcttccatttttgctgtgtccaatagcagttttctactgccattttggcttctgttaactgtttatctgccattcttctaagctttactaatagtctctgtgatgattttttatcctctgtccattgtgcggtcccaaagtcagtaccacatggttagaacagccaatcacatggccgaacccagagccaatgcagaaggcaagtaggcaagaatgtgggtattgggaggtgtgatttattacgggacatgagtggaacaatctaccatatgacctatgtcaacaggtaccctttctattaagtagtaagaagtaggagtcttaaaagaagattctagaaaaggagagtctttagaaggaagacagttttgaggaattataaagat

SEQ ID NO: 382860 - DNA, 707 bp, Homo sapiens
agatgtgacattacggtcatcctgaacctaggcctcaaggagccttgctgtttctgctcactctccaggaaccctgcctacgccatgaggacaggcccaggctagccttcggatgatgagagacctgtggccctgctaagcagcagacgtgagagatgccatcttggagctgctagctgtggtccacccatcagcgcctgcaggcacatgctgagattagtcgatttcctaaaagttgaaggaaaaatcacccagctgacctgtttgggttatgattttaactcactaagctttggggagctttattacacagcagaagctaactggtgtattactattattactattattctaagaaccaaataccaggcaaacctctaggaggaaaattgtaatgaaagtcacctcattgatttgtggccgggctcagtggctcacgcctgtaatctctgcactttgggaggcagaggtgggtggatcatgaggtcaggagatcgagaccaccctggccaacatggtgaaacctcgtctctactaaaaatacaaaaattagccaagcatggtggcaggcgcctgtagtcccagctactcgggaggctgaggcaggagaatcgcttgaacccaggaggcggaggttgcagtgagcccagattgcgccactgcactccagcctggcgacagagcgagactccatctcaaaaaaaaaa

SEQ ID NO: 382861 - DNA, 3525 bp, Homo sapiens
  misc_feature (2475)..(2475): n is a, c, g, or t
ccgacagccgcgggtgcgtggtcgtgcggcaagtgagcgatttggtgaacagacactcccttctgtagccatggattgttacagaacttcactaagcagttcctggatttaccccactgtgatcctctgcttatttggttttttctccatgatgagaccctcagaaccattccttatcccatatttatctggaccagataaaaacctgaccagtgcagagataacaaatgagatcttccccgtttggacatactcctacctggtgctgctgctgcctgtgtttgtcctcaccgattatgtccgctacaagccagtcatcatcttgcaaggtatcagtttcatcattacctggctgctgctgttgtttggccaaggagtgaagaccatgcaggttgtagagttcttctatgggatggtcaccgccgccgaggtggcctactacgcctacatatacagcgtggtcagccccgagcactaccagagagtgagcggctactgcaggagcgtcacgctggccgcctacacagcagggtcggtgctggctcaactcttggtatccctggcgaacatgtcgtacttttacctcaacgtcatatccttggcctctgtctccgtggctttccttttctcacttttcctaccaatgcccaagaaaagcatgttttttcatgcaaaacccagcagagaaataaagaagtcatcaagcgtgaatccagtattagaggaaactcacgaaggtgaagcaccaggctgtgaagagcagaaacccacatcagaaatactcagcacttcagggaagctgaataagggccagctgaacagcctgaaaccaagcaatgtgactgtggacgtttttgtgcagtggttccaagatttgaaggagtgctactcctcaaaacgtcttttctactggtctctatggtgggctttcgccacagcaggttttaaccaggttttgaactatgttcaaatcctgtgggattacaaggcgccatcccaagattcttccatctataatggggccgtagaagctattgcaacctttggaggggctgtggctgcctttgcagtgggttatgtgaaagtcaactgggaccttctgggagagctggctctggtggtcttctcagttgtcaatgccggttctttatttctcatgcattacacagccaatatctgggcgtgctatgctggctatttgatattcaagtccagctatatgcttcttataaccatagcagtatttcagattgcagttaatctgaatgtggaacgctatgccttggtatttggaatcaacacctttattgccttggtgattcagaccatcatgactgtgattgtagtagatcagagagggctcaacttgccagtcagcattcagtttttagtttatgggagctattttgcagtaattgctggaattttcctaatgagaagcatgtatattacctactcaaccaaatcccagaaggatgtacagagccctgctccaagtgagaatccagatgtgtctcacccagaggaagagagtaatatcatcatgtcaacaaaactctaacctcatcgcaacaaacgcaacagtggctttcaaagttatgcaataataaggaaagattttgagatgggtggcatatgttttgccataacttgacatgctttgcaaatctggattccaatggacctttcaaaaccacaacaaaacctcagttttagatgagttctctatgtgaccaattttactggatgcaattgacaggacccgtcatcataattaaacaacccatattggggaccccctgtgactagtagcagctggaaaattctggtttttatcacttgtaaagacatgcagatggcgtggaaccaaaccatgagaaaactccagccatcctggagttgatattcaccatttgtgaggagaaatactaactggactgaccctattgctaggcttaaatacttatttgatcttaccaaagaagtcaacacatgggacctttgtgtcacatgaaccattttctttcctcttctattaagtgtatttctgtttaagttacagttctctaagagaattacaatgtttgtcccatttctaagggcttctcttcaactctaataacagcattattcacgttatgatttgatagtattattatttaatttttttatgattattttccattttgtgctctgagttttgctgttgaaagtctccctcaagaatagcttcagatcctcttgtgtatttgcagaatacacaaggtcatttcccagtggcctgggagaggcagtgagccttctctccaccaccatagacaggtgttaatgcatctatgggccaggtgcagtggctcactcctgtaatccgagcaatttgggaggccaaggtgggagttttgcttgaggccagaggttcaagaccagcctgggcaacacagtgacacctgactctactaaaaaattaaaaaattngctgggcagcgtggtgtgtgcctgtagtctcagctacttgggaggccatggtgggaggatgggttgagcacaggagtcagaggctggagtgcaatggcgtgatcttggctcactgcagacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccactctctctttctcctgctttggccacgtgaagatgcctgctcccactttgccttctgccatgagtaaaaattccctgaggactccctagaagcagatgttgccacgcttcctatatagcctgtgagctaattaaaccccttttcttacaaactatctagtct

SEQ ID NO: 382862 - DNA, 472 bp, Homo sapiens
tacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggagtgcaatggcgtgatcttggctcactgcagacttcacctcctgagttcaagccattctcctacctcagcctcccaagtagctgggactatgggtgcacaccaccacgcctggctaatttttgtatttttagtggagatggggttctatatttaatcttcttctgtcttttcttctttctctttctcgatgatctttttttatatctttctatctcacttttactcactctttttact

SEQ ID NO: 382863 - DNA, 265 bp, Homo sapiens
tacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacacctgtcttgaacaaacaaaccaacaatcaaacaaataaataaacaactgaaactc

SEQ ID NO: 382864 - DNA, 1197 bp, Homo sapiens
tacagtgagctatgattgcaccattgcactccagcctgggcaacagagtaagactctcatccccctcctcccaaaaaagagcacctgtgtggtgtctgtctaaaataggaaaacttaaaggaggtttctagaagtattagaaataagaaaacactgatggggggagtggaataaaacacctgattttgttttgttttggtttttgagacagtctcgctctctcacccaggctggagtgcaatggcgtgatcttggctcactgcagacttcacctcctgagttcaagccattctcctacctcagcctcccaagtagctgggactatgggtgcacaccaccacgcctggctaatttttgtatttttagtggagatggggtttcacaatgttggccaggctggtctcaaactcctgacttcaggtgatctgtctgcctcggcctcccaaagagctgagattacaggcgtgagccaccatgcctggccaaaacacctgatttttaaatggtagcaattgtgctaaataaaatgtgtaaaaattttaaagagttgttaacattttttgatgaattctgctgaaaattatctgaacatacctgtttttcgaaacttcaagaaacttcaataagggatgcattgagcagtctgacagtgagaataaagaatgctgagtcaagatttatattaaggctggaagctgtggctcacacctgtaatcccagcattttgggaggctgaagtgagaggttaatttgagggtaggggtatgagaccatcttggccaatatagcaagaccctgtgtctaaaacaaacaaaaaaatttttaattggattttgatatggtttggatctgtgtccccaccaaatctcacgttgaagtgtaatccccaatgttagaggtggggccggctgggaggcgactggatcatgggtgtgaagccttcatgaatggtttggcaccgtcccctcagtgctggtctcatgacagtgagttatcgtgagatctggtagtttaaaagtgtgtagcacctccccactctctctttctcctgctttggccacgtgaagatgcctgctcccactttgccttctgccatgagtaaaaattccctgaggactccctagaagcagatgttgccacgcttcctatatagcctgtgagctaattaaaccccttttcttacaaactatctagtct

SEQ ID NO: 382865 - DNA, 364 bp, Homo sapiens
tttggttttttctccatgatgagaccctcagaaccattccttatcccatatttatctggaccagataaaaacctgaccagtgcagaggtaagttaacatacatacatatcttaatgtggttttttaaattttatgggacttgaacaaggatacagggcttccctcaacttgatataagatgaacacattaaactcagtgagcctgattttcataatatgtgtcccatatagaacttttcaaactatttcctcttcttacttgcaaaaaattgcagccaaaacatattacatgtgttaacaaatttttaacttgcatagagtcctaacatttgtgttaatgataggagactttcaggtctccgtt

SEQ ID NO: 382866 - DNA, 369 bp, Homo sapiens
gcgggtgcgtggtcgtgcggcaagtgagcgatttggtgaacagacactcccttctgtaggtaagaatatctcggggggcgaattaattgaagaagcaccgtcatccctcggtcttagcagtgtcgcctctctcttcccgggtttggagagctgggggcgggttcctggctctgcgggcctgggctacactctgagccgcgtgaggagctctccccctacgccgcagcccgcgtgctgggattcacccaagtgggtttgtctggaattcccatttgcagccttctggaagcgcagattaaataaaatcatgattcccgtaaagtgccagcacctcctatggttacatcccacgttcacagattttaactg

SEQ ID NO: 382867 - DNA, 769 bp, Homo sapiens
tagaattttgctgactaatattcctttgactagtttgaataacattggatcaactcagatgatggcattcttatgttttgattagtgtatacatggtgtacattttttcttttacttttcacttatctgttcttttatttaaaataggctttttgtagacagcatattgtcgaaccttgcctttaaaaaaattgaatccgacaatatctgtctcttttttttttttccttgagactgggcctcggtctgtcccaggctagagtgcagtggtgtgatctcatggctcactgcagctttgacctcccaggctcaagtgattctcctgcctcagcccgtcaagtcgctggagctacaggcacatgccaccacgcctggctaatttttgtattttttgtagagacggggtttcaccatcttgcccaggctggtcttgaactcctgagctcaagctgtctgcttggcttggcctcccaaagtgctgagattataggtgtgagccaccactcccaccccagtatctgtcttttaattgctgtttagaccagggaccaacagactttttaaataaaggaccaaatggtacatggttacaggtcatgcttgtatgtcatgcagacattcaactatgctgtaacatgaaagctgctgtacagtatgcaaatgaaccagtatgtctgtattccaagaacactttataaaaataggcatgggccagatatggctccaggactctagtttcctaaccttggcttagtgtaatatgatcact

SEQ ID NO: 382868 - DNA, 480 bp, Homo sapiens
gctgactcctttctcggactcagcccacctgcacccaggtgaaataaacagccctgttgctcacacaaagcctgttggtggtctcttcacaaggatgcgtgtgacatttggtgccaaaacccaggacaggaggactccttcaggagaccagtcccctgtcttcgccctcactccgtgacctcaggtcctcagaccaaccagcccaaggaacatctcaccaatttcaaattgggtaagcagtcttttcactcttctcatgcctctcttgctacccttcaatcttcctctcttgctacccttcaatctccctgtccttccaattccaattctttttcctctctagtagagacaaggagacggccaggtgcggtggctcacgcctgcaatcccagctctcagggaggctaagaggcgggaggatagcttgagcccaggagttcgagacctgcctgggcaatatagcgagaccccgttctccag

SEQ ID NO: 382869 - DNA, 786 bp, Homo sapiens
gctgactcctttctcggactcagcccacctgcacccaggtgaaataaacagccctgttgctcacacaaagcctgttggtggtctcttcacaaggatgcgtgtgacatttggtgccaaaacccaggacaggaggactccttcaggagaccagtcccctgtcttcgccctcactccgtgacctcaggtcctcagaccaaccagcccaaggaacatctcaccaatttcaaattgggaccccactggaaatcagactgtccaactcacccagcagccactcccagagcccctggaactctggcccaaggctctctgactgactccttcccagatcgtctcagcttagcggctgaagactgacactgcccgatcgcctcggaagcctacaggaccatcacagatgctctggataactcttacagtggagggttaagacccaaactggttcaattggcatctgacgccctttgcaaatggctctactctccttcatcaatccatcacccaaagacagcctgatctaaaaggatagattcttcacacatgccatccgcactcctgccttcatatgaagttactcctactttttggccacctctccttcgaagcccagcctcaactcccacctcctccttcatgaagccctccccagccacataagttctcagtagtcatttctctgaattttgagtgtcttcctgtctatataatgtgtctggcactttaagaaacattagactgttttggaaaatgccttgggctttggaataaaatagagctggtgatgtt

SEQ ID NO: 382870 - DNA, 279 bp, Homo sapiens
ccctgaacttggaactcagtacatctaaattaggacccaagaactgcattttcaaaaggccctgctggtgactcagatgcagatcttccaagggttacatctggagcattggcatggggccaagaatacaggcttgaaatcagaaagacctgaatgcaaattttgactctgcaaatttttacctatgcagcacacaacaaactactcctttaatcactgaaaaactactaatacctactacaggctatgcactttacttttctaagcctctatttcctt

SEQ ID NO: 382871 - DNA, 237 bp, Homo sapiens
ggtcactgatacaaacactacagattttacctggttcactatcaatactgttatgctctagcgctgggtggaaagattgtcagtctgctctttggttaaatcatgtattcaggcgggcgtggtggctcttgcctgtaatcctagcactttgggaggccgaggcaggcggatcacctgaggtcaggagttgaagaccagcctggccaacatggtgaaaccccatgtctactaaaatac

SEQ ID NO: 382872 - DNA, 481 bp, Homo sapiens
gtcacatgaccgtcatactacttgcttacccaggttatgccgttgatcttaagtctactttatccaggaactttctctccttctttggggtcctttacttggtattgattgccttttgggacatagaaatactgttgcaggtaatgatgccttcaatttcaaattgcagtacttttagttctaagtaacttggcccttttagacagaaactgctgtgctgagggagtcccagccctctaatccaagcaggggacagtcccacaagtgaccttgacttctgcaaagaacttagtttttcctgcggataatttaaagctgacagcatctgaaggaaaggaaagccttaggatggttttggcttgctgtatgtaatttttttttttttttgagacaggatattgctctgtcactcaagctggagtcttgtggtgtgaccaaggctccctgcagcctccacctcctgggctcaagcaatcctccc

SEQ ID NO: 382873 - DNA, 543 bp, Homo sapiens
aaaggaaaacctagggactgacataattcaagttttccgaagttagtaaaaggccctgaaaagagtgcaaatgagtgacaactcctggaggtcgggtccagcctctgaaattaacatgcaagagcccaaggccaggcaaccaaaatgtgaaacagactctgcccggggttcctttcactgtcaaactcctagccaaaagaggcttcccacatcagatattttaaatattaaaatttaaaaagttattcacatctattcacctctcccttgaaaaacaaatgaataaatagcccctatttgcgtctttactcccacactaaacctcacaccgttgatgagcctggagggctaggttggcacgagaggatggcgccaaagctcggggagagggcggtcagtgggcggaaggtgcctcttcccacatggccgagccctcgccgccactggccaccggcacacggtccccaagcatcgggagctccctctcggccctgaccccgcggtctctgtcgccccgcaaacggccgctgcggccgcaggctc

SEQ ID NO: 382874 - DNA, 796 bp, Homo sapiens
gctgttatattggagtgggctcccaaaggcccctgttgtggatatttagttgctggattgtggggagtttcaggtgctgcagcccagcagctgtttattagccaattaagtatgtcagtattttgcacctgatacagccgtattgtacataccagttaaatatcagcctaccttgtaacatcacgtggagagactctagagcaggttaggttggggtgtgaggtgatagcagagaaggaaagaccctgggcttttgagccacctcatggtttttaccccatctggctgaatctacaggcccatctcaagtagagaggccagactataaaagatagttggtttccacagtttttcttgatcttgagaaaagacaaaaaaataaaaataaaaaagaagaaaagacagccagggaagtgactctcagaaacccaggaaccttataagctaagctgcttctcattcttctccttcactggggatggaattgtctccctcatacctgccttcggatccgagcctatagcttgggagggcctgtcacgcacacagtcgaaaaggctggaagttacttccaatggataggggcccaaattgtaggtaacagcccattttattttaggttggcagagaatggagacatagttgagagatcacatttgacatcagagggcttttatgtccattgtgactcctctggactccccgtatgacagtcagcatgccatttgtatccctacttctggggctgtggcagtacagagttgtgcccagtaggccaacagcatcacctagaaaa

SEQ ID NO: 382875 - DNA, 451 bp, Homo sapiens
ggtgagtgcccagctctgaccaggggctcagtaaatgtcagctctgggttattgcattgacccatctggtgctggggccacactgagtggatgtcagggagacaggctatgggggagggaactcctttgcaattgtccctgctttcagtactgatgggggcacctctggagacctctcccttgatttcattacttctacttcctctcctaactggattagatggcagtctatgaaatccagggcatagagattggctttctgcctggaaatgagcagaaatgtcattataggtcctgaatcagcatctcaccacagccccaggggccacctggtcaatgggaaggtggtctttgccctgtatttatgctttccttcattctctcctgcattcatccatccattcatccacccactcattcatccatccatccaatatgcattttgtagctc

SEQ ID NO: 382876 - DNA, 457 bp, Homo sapiens
aatacttcaggaaccaccagctcccaacagttcgcagttccaatattagcttgcgctacattcctttgatctttctgaagttgggtttttagcggttgctgtgataaaagcaggtagagctcaaatcaatgtggagcaggatatgagggagaggtatctccaatttcaaggttggaggacttatgcagcatccaacaggtacttactcacattaataggtaattttcctttcacttttcatatatatttggtcaagcatctaaaagtttaagacataaaaccttaataaattgtttgacaaaaataaaaataaaaataaattgtttggcgctaactgcttaataaaagtcgtgacagtctcgctgagtgtatgcgggggattggtgccaggaccaccagcaaataaccaaatcctcgtactcaatcctgcagtcagccctgcagaacctccctatac

SEQ ID NO: 382877 - DNA, 1803 bp, Homo sapiens
gagaatcgagcgcagcctgtgctggttgtgtaagccgtgggacacacgggaaagccaggaagaagaggaagagcacccccacaccccacccgcgtgaagaagagcaaccccactccccgcccgtgggaagaagagcaccctcacgccgggcccgcaggaagaagagcacccccacgcccggcccgcagcatcccgctggcttcctggccacctctcctcacccatcttagaggcatggcgggctggggcatctttccctccttgggcaggatgaaacaggcgcctatttaatcgacagagaccccacctactttgggcctgtgctgaactacctgagacacggcaagctggtgattaacaaagacctcgcggaggaagatgataccacgagtcaacccaaaagttgctggggagaagtttctctttaatgaattgcatctcatgaatgtatcaggctgtgacctttctgcactctctaatgagttcatgaatttaggccaattatggccacaaatgctgctgctgtcacagagagatgccggataaagaacacccaccaccagtctctgaacagggaggggagaatcaactctgaatgtgatgtagtggccaggagagaggaccatgttcaacaacgccacacagatgcaaatgacttgtttcttcaacaaactgcaagggaaaaaataaaaatgggggaagctacagattaaaatacatgtgtttggataggagagtatttaatggcaaaagaaaaagaaaaaatttaaaaatgaaattgtgcaaaacttatttgaatcctgttcaagtgagcaacaaaacattatgatgtacatgagacaactggaaatataactctgactggacactttgagatattaagcaattaccgttcatttttacatatcaaacagtatggtattgtggttacgcttttaaaaagatttgtattttagcgacacatactggaatttttacagggaaaacccactgaggatgctgggcatcaggtcactagcaccgagtgaattttttacaataagcagtaattctccccagccccatgcatcatagccaatcctaaatgaatgccaatctggaaaagaccaaaataaaccacgtgaagatgggaagagctgctcttggtgatgggagaatggggactctctcttttattgtgcaaactccactttccatcatgcaggaaaatccgtcttgaaggcagctcctctctgtgccgggggtgggtgatccagcctaagctagaatggcggcaagctcaaggcagctgtggccctcaggagagcgtctggagtccacagcacagtgggaagcgcaacggcagctagtctgagggtctggacgatggccatgcacagatgaggacagaggagccactgtagtgactgaagcccacggcatccaccctctccagccagccccgcccacacctgaagcccacagcgtccaccctgtccacccagccctgcccacacctgtggccttcctctccttcctgtttggtgagtgctgcctccacacctggctgcatgccagaaaggcctgcacaggtcagaacacaggtttccaaaccctactccaagtctgaacctccaaggacaccccgagctccccaaggttcttgcatagagggcacaggccagagacagcccaggtgggaagcttactctgagtcagctgccctcaccaagatacatccacaggctcctgtacaaggagaggaggcagaagtccctctctgccaggaggtcctcctcaatctcccaagcccacaccactgcc

SEQ ID NO: 382878 - DNA, 1844 bp, Homo sapiens
tttcattttttcactatggaggctgccaccaagacccagctgtgtctctcaaagaccctcatgcctgctggacgcctcctccctcccacacccgcaccctccagggcctccctgcgctctgggggacgtgtcccactgcagctggtgtgtggccgagcaacccgaaggccgggctgcctgccctccaccccgacgggggacagcaccaaggaagcctgggctctgtgcacacggcagccacgctttcctcactcaatagtttttcccaaagaaacgatcaggctgggcatggtgtgaggaagggtaataacttttttaatgaattaatcatcattggaagagaatggagaaccaatgtgtggttttcaaaaatggcatgaaaaggggaaagaagcatttatcctacttttcttttacagatgataccacgagtcaacccaaaagttgctggggagaagtttctctttaatgaattgcatctcatgaatgtatcaggctgtgacctttctgcactctctaatgagttcatgaatttaggccaattatggccacaaatgctgctgctgtcacagagagatgccggataaagaacacccaccaccagtctctgaacagggaggggagaatcaactctgaatgtgatgtagtggccaggagagaggaccatgttcaacaacgccacacagatgcaaatgacttgtttcttcaacaaactgcaagggaaaaaataaaaatgggggaagctacagattaaaatacatgtgtttggataggagagtatttaatggcaaaagaaaaagaaaaaatttaaaaatgaaattgtgcaaaacttatttgaatcctgttcaagtgagcaacaaaacattatgatgtacatgagacaactggaaatataactctgactggacactttgagatattaagcaattaccgttcatttttacatatcaaacagtatggtattgtggttacgcttttaaaaagatttgtattttagcgacacatactggaatttttacagggaaaacccactgaggatgctgggcatcaggtcactagcaccgagtgaattttttacaataagcagtaattctccccagccccatgcatcatagccaatcctaaatgaatgccaatctggaaaagaccaaaataaaccacgtgaagatgggaagagctgctcttggtgatgggagaatggggactctctcttttattgtgcaaactccactttccatcatgcaggaaaatccgtcttgaaggcagctcctctctgtgccgggggtgggtgatccagcctaagctagaatggcggcaagctcaaggcagctgtggccctcaggagagcgtctggagtccacagcacagtgggaagcgcaacggcagctagtctgagggtctggacgatggccatgcacagatgaggacagaggagccactgtagtgactgaagcccacggcatccaccctctccagccagccccgcccacacctgaagcccacagcgtccaccctgtccacccagccctgcccacacctgtggccttcctctccttcctgtttggtgagtgctgcctccacacctggctgcatgccagaaaggcctgcacaggtcagaacacaggtttccaaaccctactccaagtctgaacctccaaggacaccccgagctccccaaggttcttgcatagagggcacaggccagagacagcccaggtgggaagcttactctgagtcagctgccctcaccaagatacatccacaggctcctgtacaaggagaggaggcagaagtccctctctgccaggaggtcctcctcaatctcccaagcccacaccactgcc

SEQ ID NO: 382879 - DNA, 259 bp, Homo sapiens
tttattaaaatcttacagaatatgtgtttggtggaatacagttttggaaagagtgaatctttatcccaaaggaatggacatcaaatagagtaattccagatgaagataatgttactattaccttcatctgaaattccagatgaaggtagtaatcactatttcctgtgtgtctgcataaggatagctctaatccgcagtggaactctaaaatagggaggaaggaagaattctgcattctttcttccactttgaatcctct

SEQ ID NO: 382880 - DNA, 227 bp, Homo sapiens
tgcattcttgcctctttgacaagttctgcttctttacaaaggactttgcaagtacttcacccagaccatctcacctgtaccgaaataacctcccctactagcgaatgagcaactttggagcagaaagcagaaactgcatcatatttctcttactatgcaaactggtagctcaaacctcatatgacctcaaaaaactataattgcttcaacctaaaaaagctgattgt

SEQ ID NO: 382881 - DNA, 399 bp, Homo sapiens
actacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcactaaaagcactctgagtcaagatgagtgggaaaccatctcaataaacacattttggata

SEQ ID NO: 382882 - DNA, 338 bp, Homo sapiens
  misc_feature (23)..(23): n is a, c, g, or t
  misc_feature (44)..(44): n is a, c, g, or t
  misc_feature (150)..(150): n is a, c, g, or t
ctgagtaagcatactgtagtacnaagagcttagtagtagttttngtaatataccttaaagatcttcaaacagttgatcttttttcagaatgttggaaaatcctgtaaatgcaaatagtcaatactgtattaaatacgtgcacttggagtngtgtcgcttgtacagttgtaaataatcagaacatatgaaaaaggtaccctacagagaaaattctgatacagattattgatatattataaatgttgctgttgagcgggatgtagataaactgaagcagcactaaaagcactctgagtcaagatgagtgggaaaccatctcaataaacacattttggata

SEQ ID NO: 382883 - DNA, 393 bp, Homo sapiens
aacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaagcagcactaaaagcactctgagtcaagatgagtgggaaaccatctcaataaacacattttggata

SEQ ID NO: 382884 - DNA, 390 bp, Homo sapiens
  misc_feature (347)..(347): n is a, c, g, or t
  misc_feature (376)..(376): n is a, c, g, or t
atgaagcagaagaaccaaccagctgaggcctgcccgaactcctaacccacagaattgtgacaaatgattgttatggtgctaagtaccataagatttgggccaggtgtggtggctcacacgtgtaatcccaacactttgggaggctaatgtgggaggatcacttgagcccgggagttcaagactagcctgggcctaatcctactgaaactgttctaaaagacagagaaagagggaatcctccgtaaatcattctatgaagccactaccatgctaatatcaaaaccaggaaaagacataacaacaacaaactacagaccaatatctctggatgaacatagatgcaaaantcctcaacaaaatactagctaaccaaatncagcagcacatcaa

SEQ ID NO: 382885 - DNA, 2791 bp, Homo sapiens
  misc_feature (2)..(2): n is a, c, g, or t
  misc_feature (2489)..(2489): n is a, c, g, or t
gntagctgttccagtaggcactagagtcgtttcccagataccatgtagtgtcaccaagaccactatactcttccaccctagacgaagcctttgacagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactggggaaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaaaaaaaaactccggggcttctattgcgggggggggaaaaaggggtcttgaagggcctgggccatggggttcccggaccccttttttgtaccaagggggaaactcggggggcccccaatagggggacgaatataattcgaaaagcccgggtacccgggctagcagcccgccgacaaaaangaagaacgccaacacggaaacaggaacgaacaggaggggggcaccaccattggccacacgcaaacgggcccggccacaccgtgaccaaaggcacaacaagaacatagcgcaagaccagaagagaacgcaagagcagcaaagaacaagcaacacagatgcacagacgagaaggcaagaaaaggcaacgacacaacaggcacgagaacgaacgcgaagcaagacacgacagagcaaagcgagacgacaaacgaggaccaaagagcaacgacaaagacagcgagcagacgacacaagacgacagc

SEQ ID NO: 382886 - DNA, 2493 bp, Homo sapiens
  misc_feature (2191)..(2191): n is a, c, g, or t
gtgatctagaggatcccataggaagaatgtgcatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactggggaaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaaaaaaaaactccggggcttctattgcgggggggggaaaaaggggtcttgaagggcctgggccatggggttcccggaccccttttttgtaccaagggggaaactcggggggcccccaatagggggacgaatataattcgaaaagcccgggtacccgggctagcagcccgccgacaaaaangaagaacgccaacacggaaacaggaacgaacaggaggggggcaccaccattggccacacgcaaacgggcccggccacaccgtgaccaaaggcacaacaagaacatagcgcaagaccagaagagaacgcaagagcagcaaagaacaagcaacacagatgcacagacgagaaggcaagaaaaggcaacgacacaacaggcacgagaacgaacgcgaagcaagacacgacagagcaaagcgagacgacaaacgaggaccaaagagcaacgacaaagacagcgagcagacgacacaagacgacagc

SEQ ID NO: 382887 - DNA, 1441 bp, Homo sapiens
  misc_feature (1139)..(1139): n is a, c, g, or t
ttagttggccgtggtgggggatgccagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactggggaaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaaaaaaaaactccggggcttctattgcgggggggggaaaaaggggtcttgaagggcctgggccatggggttcccggaccccttttttgtaccaagggggaaactcggggggcccccaatagggggacgaatataattcgaaaagcccgggtacccgggctagcagcccgccgacaaaaangaagaacgccaacacggaaacaggaacgaacaggaggggggcaccaccattggccacacgcaaacgggcccggccacaccgtgaccaaaggcacaacaagaacatagcgcaagaccagaagagaacgcaagagcagcaaagaacaagcaacacagatgcacagacgagaaggcaagaaaaggcaacgacacaacaggcacgagaacgaacgcgaagcaagacacgacagagcaaagcgagacgacaaacgaggaccaaagagcaacgacaaagacagcgagcagacgacacaagacgacagc

SEQ ID NO: 382888 - DNA, 569 bp, Homo sapiens
gtttcttgtatgtgggaagaatctatgtttgagctatactctgtttggcagtttgatggccagctgttcaattcacgtcccacagacctgacatacctagtgctgacggagtgctccagtagtttaagagttaaaaacatgtgactcatgtgcccattcaggccttctgtctcatagatcttctccttttcgataaccatattttgtgaatgatgattttctaacacaccattgcaagtttctacaacttacttagtcgttaatagatattctgactgtgttcacagttatagtagtccccttttatctgcagggaatacattccaagaaccccagtggacgcttgaaaccatggatagtactgaaccctatggatactgttttttttcctatccatacctacgataaaggtatgataaataatacactttaaggccgggcacggtggctcatgcctgtaatcctagcactttgggaggccgaggcaggcggatcatgaggtaggagtttgagaccaccctggccaacatggtgaaaccccatctctactaaaaatacaaaaaaaaaaa

SEQ ID NO: 382889 - DNA, 906 bp, Homo sapiens
tagaagaaaaggttggttcagataaaatgaaaattataagtgaagggtgagattcacattctggaagatctgtagtttacttggaggatgggttttcaaccttgttctattattctatgcttctctattatacaagataaatggatggtttctacccatccacagctccccaggagctccatctctcttggtggtgccatttgaccaccctccctgctaccctgtagtcacaactgattgggccaagctgggccattctcacttttctctcttgaaatttaatgttaagacatggaaactgagtacatcaggtggttacaagctctgggtttgtaagtcacagccctaggtccatacctttgtattcccttcaccctgtagtgctgtaaaggaagagaaaccaggaaggtgatactcatggaagagatttgaagatacacacacacacacacacacacacacagagagagagagagagagagagagagagagagaaagatcagattgagcttggtaaatctcctgggtcagggtaccccaagattgtccaaacaacccagaggctagggattggtgggatccagaggttggtagctcctgtgaacttcctatcatagcccttggatatccctgactggagaagctgctgagaactcatctgtgaagttgttgcctcagaccccatgttgtccagtaatccttccttccaggccactgtctttccccctggacaaaactcagtgtggagttgggctctttaactttctcacattttaacttgaggagttggaccagatcaatattccctgaagtatgatatgtgtactactgctagtattatactgatgtttcaattatacaagataatttcaggaactatgtgaataaatatttcttttattgtgt

SEQ ID NO: 382890 - DNA, 425 bp, Homo sapiens
ttggtggtgtgggtggctctgctccatgaggtcactcaggtggacaggaggcacgaccaccctgagagcacagccttcctccttcctcacagtcactgcccccatggtcatcctcaacagcatgaggtggaactgaatggagagaaagctgttttcttctaaggatcaaaaataaatacagaaacaaataaaacctctagctttccatcagggacaaatgtacttttgactcagtcacagatttgagaaattttccattgagcgggtctgctggtaaacccacgttcattgtttgtttgttttaatctgaaaatgtgtttacatgattcttgaagatattctttgacaagaaacttccatatgtggtagcctatttgaagttgtcatttactatttcatcattgctgctaaaaagtcatttgtta

SEQ ID NO: 382891 - DNA, 478 bp, Homo sapiens
ataaaataggaccatgccataggagtgctaaatgcagtctttctctctttgttatcacttccataataatatatgcatactgtagtttctggaagttgggaagctatcagaacaagagcatctcacttttgacacatacaatagacaccccaaacaggaaactgatgaccttattaaaatcatagataaaatttggaaaggggccaggcacagtggctcctgcctgtaatcccagcactctgggaggccaaggcaggaggattgctggagcccaggagttcaggaccagcctgggaaacatagtgagaccctgtctctacaaaaagtaaaaattaggcatggtggcatgtggctgtggtcccagctacatgggaggttaaggcaggaggatcacttgagcccaggagttggttgcagtgagccaagatcatgccactgcattccagcctgggtgacagagtaagtgagaccctgtatt

SEQ ID NO: 382892 - DNA, 374 bp, Homo sapiens
gttgttacagacaggatcagtaagatgaaggctgagaattgagaccattgaatttagtggggtggggttgttgcagacattggtgagcagttttggtagagggagaaaggtgaattaaagcatggttggagtggtttcaggagacaaggccacagaaggaattgagggaaccattgtagataacattttcaaagaatgttgctgtaaaagagagcagagaatgggaatttttcttaagagagccactagcaacatatttgctaatgacaaataagggagatgagagaattgctggaacaattagtatttgcatggtgaattttcagtactttccttgttttattctagtatgcagttgtactgtgtaagtttgc

SEQ ID NO: 382893 - DNA, 1646 bp, Homo sapiens
tggagctcaaggatccttaattaaattaatcccccccccccagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccagg

SEQ ID NO: 382894 - DNA, 1672 bp, Homo sapiens
tggagctcaaggatccttaattaaattaatcccccccccccagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcagggtgggtcctgggtttctcgtcgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccagg

SEQ ID NO: 382895 - DNA, 1129 bp, Homo sapiens
tggagctcaaggatccttaattaaattaatcccccccccccagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcatgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccagg

SEQ ID NO: 382896 - DNA, 1731 bp, Homo sapiens
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccagg

SEQ ID NO: 382897 - DNA, 1561 bp, Homo sapiens
tggagctcaaggatccttaattaaattaatcccccccccccagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcatgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaactttgtctcttgtgatttctttagcggcatcaacatacacttctaagactcagctgatgtgcccactgtggaacaggcacactgcttgggggagggaggaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaagtatcactttgggaaagatgagaggaggggaaaaaggtgggagtagccctccaaagaggtactagggaccaagggggtgatttcagaacacaaagccttacttcaggtctccatccagg

SEQ ID NO: 382898 - DNA, 305 bp, Homo sapiens
ctttttctgtaaaaatggctgctcataatatctcttcatcattcacagattttatgtgcaaaaataacctctccctatccataggagtatactgacaactccacattttatgatatgtgagcctcacaataatcccttcaggctgacagagtcgttattccaatctccagtgaataggtgggaatttccaatattttcatctctaatttcctttccagttctgatcgactgcagtgcagtttaatagtagaagagaagctaagattggtgaactagcttcacatgaacctccaaaacagtctccc

SEQ ID NO: 382899 - DNA, 1062 bp, Homo sapiens
cagtaattctcatctagcctgttgtctttcatacgaagacaacagaaaggctttctcagatctgcaagagctcacagagtctgtaatacccatgtgccctgagtgaatagacctgaggtaaggttctggcagccccacatgcaaacggtagaaacccaagccagtttttaagctcttgaagccctagtttctttatttgtaaaccaagtaaaagtaaatgatttacttcataaaattgttataaaggttaaagggacagaatatatgccaagctctttgttcactgcttagtactcttttaaaaaaataatagaatttattggaacaaccaatcttagccaaccatgagaggaatcacaaacaagaagaaaagaaagccactgcaccccgctaaaatttagacttttagagattattacaaacaaaattaaaaagcaattgctgtacataataaaaaattgacattcaataagaaagataaacctcctaataaggaggctttattcaccaaaggacgtgaaagtgcagttcaccaaagaatatctctaaatgatcagcacacacacacaaactaatattgctgataattaaagaagtagggacaaactaaatgcctaaccatagaccattggttaagcattaaattattagttaagcattatgttatggcacatccataggaataagtatgccatatcattaaaaatcatgtcatagaagaatattttataaggtgggaaataatttgctatgaaaaaatgcttggttaggccgggcacagtggctcacgcctgtaatcccagcactttgagaggcctaggcgggtggatcacctgaggtctggagttcaagaccagcctggccaacatggtgaaacctcgttgctactaaaaatacaaaaattagctgggcatggtggcacatgcctgtaatcccaactactcaggaggctgaggcaggagaatcgcttgaacccaggagctggaggctggagtgagctgagatcgcgccactgcactccagcctgggtgacagagtgagactctgtctcaaaaaaaaaaa

SEQ ID NO: 382900 - DNA, 401 bp, Homo sapiens
ttgaatcttgagaatctcatccaagtccaaaatcatttttaataatccctccttctgattaaaatagcaaagaaaaaaattaggtaacaatcattgtctactcattaagtggatatagattattcattgtttggcatatgaagcaataaatttgaaagccatcaaggagatgtatgagactgggctactcattgaacatctgcaaatcaagacgggtctagccttggattctgaagatactgggagatgggagggatggttctgcttcttctctgccctttgggtttatatggataaagtcatcttgggtaatcttaaatttgaggatttctgagggttctcagggtcagcgttgtgcacaagttgcacttggagttagaggttaaaaacagcttagtcct

SEQ ID NO: 382901 - DNA, 445 bp, Homo sapiens
tctcagtttccccctctataacaacagcaccagcctcacagggatgtcttaaagatgaaatgggttattacatatgctcatgggaatgctcattaagccctagctattattataatttattattccatctctactttcaaccagcatggaagagtgctttgaaaatacttcacttaggccgggcgcggtggctcacgcctgtaatcccagcactttgggaggccgaggcgggcggatcacgaggtcaggagatcaagaccacggtgaaaccccgtctctactaaaaaatataaaaaattagccgggcgcagtggcgggcgcctgtagtcccagctactcgggaggctgaggcaggagaatggcgtgaacccggaaggcggagcttacagtgagcggagatcgcgccacaacactcccgcctaggcgacagaacgagactccgtct

SEQ ID NO: 382902 - DNA, 485 bp, Homo sapiens
gtcatctcatcagttagcataaactcaggtgtaatctaaggagctcataaataacaaagacactcctgctacttaggaagttctaagggtttaaagtctctttaccagaaaccagggacaaaggccagtcaagttatttattacacaataggtaggcactattattattattttatttaatagagacagggggctgggcacagtggctcacatctgtaatcccagcactttgggaggccaaggtgggtggggatcacttgaggtcaggagttcgagaccagcctggccaacatggtaaaaccccatctctaccaaaaatataaaaaatcagctgggtgtggtgacgcacacctgtaatcccagctacttgggaggctgaggcaagagaatcacttgaacctgggaggtggaggttgcagtgaaccaaaattgtgccactgcactccatcctgggtgacagagcgacactccatctcaaaaaaaaa

SEQ ID NO: 382903 - DNA, 552 bp, Homo sapiens
ggtctttttcatcttttgtatttccacgcttaattgtagatattttcttctgatttacttttcatatcattaattttctcttcacctgaagagaagcatctgacctgttattaaacctccctattttattttatagtaagactattgtaatttttagtttgagaacatatatttggttcaatttccaatctgctatatcacccttttataatttccggatacctgctgataatttcaagctttggttctatttctttggacacagaaagtataattcttatagcatgtatctaataatgccattatctgtagtctctagaagtttttattggaaaatataatgcctgtcttcccaaatagtgctcttacaaaattctctagtgctgctgattcttctggcttttgctttgtttgattcctgtcccttcatgtgcctggttatcttggattttgtgctgcatattatgtttaaattttatttgtagaatctcttttctaaaaactataaaaatttgtgaaagaaaataaagaagtctaaataaatggaaaaaa

SEQ ID NO: 382904 - DNA, 278 bp, Homo sapiens
ttgtcagtcagaataggatgtaaaagactatttcaaagagttaaattatttgttaatatcagagatcagccacagacaagaagtttatggatgagtgcagcagtggtccattggacatgttaaatacttatggatatccacaatttgaattgacattaaaaatgaatggatacccaactttgaattccatatcgtttttcatatcaaaaatattattttaactactgataaaccaggcaaccaccgcaagtttatcgaaatcctgccgctactaaaca

SEQ ID NO: 382905 - DNA, 277 bp, Homo sapiens
ctcagctcccaccagtggtgtccatctgggaatcagacaggtattaccgtatcttcctttttcgaagacaaatttcaaatataaatttgtatgtgaaatgtcctgacttgcaaatattggtaactaattcacatttgaaacaaaacaaaacattgtccaggccaaacaaaacagcatcaagggtcaccagtttgggtcttttgctctaggtgtttgggtttcttcaagttctgtccctggccttatcttctcatgctacaatcacttcctattaaaa

SEQ ID NO: 382906 - DNA, 578 bp, Homo sapiens
atgtttgaagtttgtaagttctgctgctttcaaccccacagatgtctcttactgcccacttgggccctggtgattaagcaactagatttggagccagtcaggcttttgtttagacattttaactttttcttgctttccttgcaaactcctcagccttcagactggttggaaagtaaatgtacaatcttacataaattttcaggtaatagcatttcagctttttccccaagattttttgcttgggaggagacagattagactggattcggagtcttgattttgcaaaggtaacaaaagacatgtttttttataagacttttcatcataagtttattttattcaacagaagcaaaatctaatataatggaaaaaataaagatctgtgataaatctgatctgtgtggataaacacaattagaaagatttaaagattaagtattgaaacaaactaccaaaatattttaatactgatttgtaaaaatttcagtacatttttcttctttgcttaattctactgggtcctgtttttcatcaaaacattctatcatgttagtatacaatagccaaaaaaaaaaaaa

SEQ ID NO: 382907 - DNA, 365 bp, Homo sapiens
gaagtaagaagctagaactggaccacctagatcacaagtgagggtagaatttgggtgggatgtcaggggtgggggcagaataggaaggtggaatgcagcaagagcaagtagataggactaagtttatatatgtatatgaaatgtttagtgtttctgcaggtgtgccagtgaccactcctacactgctggtaacctatacactcctataatctttctttagtgtagtttcacagtaggtatcaaaagcctaaaaatgtatttgccttttcaccaacatttctacccctataagtttgtcctaagtaaataatctgccatgttcattttagttgtattgtaataagaaaaagctgggcggaaaagat

SEQ ID NO: 382908 - DNA, 751 bp, Homo sapiens
aaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcatatgtaaacgtaaaacaaaactataaaatgtttggaagaaaacagaaaaatacctttgtacctgatgacatttggtagagttcttagacatgatcccaaaggcataatccacagaagaatcca

SEQ ID NO: 382909 - DNA, 237 bp, Homo sapiens
acacatattgttactacagtaacagaaaacatgtaaagaacatttgttttgatttatatatcagtctgcactgtttaattttttgtgtcataaatgctcttatttaaaaaaacaggactagttaacagtgtcaattactagtaattcatggtataaataattaaacaaggaagtgttcaaaaaaacagtgtttcaaataaagttttattttacatctttacttacacagaaattgtc

SEQ ID NO: 382910 - DNA, 502 bp, Homo sapiens
ctgtctctaataaaaacacaaaaaattagccgggcgtggtggtgggtgcctgtagtcccagctactagggaggctgaggcaggagaatggtgtgaacccgggaggtggagcttgcagtgagccgagatggcgccactgcactccagcctgggcgacagagcgagactctgtcccaaaaaaaaaaaaaaaaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccct

SEQ ID NO: 382911 - DNA, 87 bp, Homo sapiens
aaagaaaccaaaaaacacagaaaataaaagaaaggttcctctttaacttaacagacttcacttcagtataaaaacagtaagagttaa

SEQ ID NO: 382912 - DNA, 222 bp, Homo sapiens
aacatcttaaaagtttcaaatgaaggaaaataatataaatagatatttcaaaattaaagcataaaatatacgtatttaaaaagtgttaacaaaattactactataatgattaagaaataaattttcaaaaatacagaatggaatgcaattcagattttagagaaaagttttaaaagaggcaagtttagaataattcaagacaaaaagacaaaatgtgtttaa

SEQ ID NO: 382913 - DNA, 200 bp, Homo sapiens
caaaaccacaaggtgaaagacctttatggacatgacagagaggacctgagttaagagggaaaatacatcttcatagctaggttcacattcagttatgttagtcccaaacctacaaattcaacatgatccctattaaaatcctaccaatatagttcaaaagcttgacaagttgattgtgacatttatatgagagaataatt

SEQ ID NO: 382914 - DNA, 192 bp, Homo sapiens
tttgagcacagcttgaattaagctttactttgaataagtaacaaattgaagaacagagagggaaagatgtatagaatcctaggactaattcaccaggtgtggtggctcacgcctgtaatcccagccctttgggagaccgaggtgggcagatcacgagatcaggagttctaggactcctgggactcattcttc

SEQ ID NO: 382915 - DNA, 723 bp, Homo sapiens
tgtggactaggcggcatccacccctccagtatgtctcatgcgcaggaaggacaaacccaacaggctgccctctcaggccaggttgttgtccacacaggtcttgctagctttgactccctcctaccattcaccttgggtaaaaagcccattacatttgcagggaggaaggggaggtgagtgaacaatacttgctggttaaaacatatatatgttgtatttaggaggcttttttaaaaggagcttatagcacctattatatactccactctcatttcaaaccccctgaggataaagaacagggattaagacagccctattcatccttgagacacccccaaggaggtgttgaggaaacagcattatgtctctctaacaaaaagaccaaacctacaggtgatttgccttcaaggtcatacatcaagtccatttcagaatttatggcagtgaactggtattctggttctgaaattggtgtcctccaaaagcttcaagctgcccgtagtaaatgatgcacacagtcaccctaactgccctggctctcatttgtaagggtggtccaggatccacagccccccaggaaatggccctctgacaaggtcttgcatacttttgggtgtgcccccacgcagtgtcttaaaccagcagcatgctctcagggacaccacagcaaggggaaggggtggtttatggacattccattgaaacctcagtttcctcctctgt

SEQ ID NO: 382916 - DNA, 405 bp, Homo sapiens
agttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatc

SEQ ID NO: 382917 - DNA, 217 bp, Homo sapiens
aatcaggagaactgttagagccataccagagaaaatcacaagaaaggcaggactgcaaagatctagtggaggctgtgagaaaaggtaaaccccttcttaagctcatctgcccctttagttaccactggctgtctcactcctggatttatgtgactcccttagctatactttcccagccccctgggatgttccccactcatcctattcacccacaaag

SEQ ID NO: 382918 - DNA, 407 bp, Homo sapiens
ggaagatgacttctcccgaggaagtgtattcagtcccgtctaatctaatgtttttcagtcccatttaaaggctggtgagctcggtgacagcccactcacaacctggtcactctgggacacacacaaccttcagggtgtccttccttccccactacccccttgaaagcctcatggcacttggggaggaaacttcccatctgtcactgtcctcttggcctcagcagcctcaccagcagaagagctggtcagtttagtccccaggcatggttcccagagttcctccctagcctatggcatcaaggtcccattttctgtcctctttgtcccagccccaggcccttcggagtccccagacatctcccagcggcttccatatctttttccggtcttgctcaagaccattcatg

SEQ ID NO: 382919 - DNA, 321 bp, Homo sapiens
taagaaatatgataataacttatcaattaaaagaaactatccacaacctgttaatgaaactaaaaactattttgaattatatattttccgggtttatgatcatcttaaaatgaaatcatattttgagatagtagctttaaaccattttgaaatatgttgattttttccaggtaatttaaaaatattattaaatagttaattataaaatttatactggtattgtacccattagtggcatgtttttcattgtattttcttccattcatttaatgattggctaatactacttgtttttaaagaagtaattgaaatgtagaagag

SEQ ID NO: 382920 - DNA, 486 bp, Homo sapiens
ctcccctgaaccttccagaagggccttctggctcagaaccagacccctgcctggttactccgtctgcccttctgcctgattagagcaagggtctcgcacaggctggacaatgcccaagtctgtgctgagcacaaaacaaggccatgtgatggaggggcagggtttctggatgctgtcattaatgataacagcctgaactatatccatgacctttaaaaacatctttaactgaaggaagttaaaatacagaaagagggaagattaggacaaaccttatggttggattagatttagagatattggtaggagctcatgatttcattacatgcacacacacacacagagattgatatagaaatttggctgggcgcagtggctcacgcctgcaatcccagcactttgggaggccgaggtgggcagatgacttgaagtcaggagttcaagaccagcttggccaacatggcaaaatccagtctctactaaaaa

SEQ ID NO: 382921 - DNA, 966 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382922 - DNA, 541 bp, Homo sapiens
aggggcctcaacccagagcccctctcacaccctctctccaactcaggcttatgtctctccctcctcccccacccccaccccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382923 - DNA, 228 bp, Homo sapiens
gcggccgcctactactactactactgctcgaattcaagcttctaacgatgtacggggacatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382924 - DNA, 925 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtaaaaaaaaaccttcgtgccg

SEQ ID NO: 382925 - DNA, 600 bp, Homo sapiens
gctgccgccggggcacgtgcgagcgtcgggcccctccctgcgccaccgcctccgggacggcgggtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggtctcttcccctgccccctcagttttccacttttggggttttttattgttattaaactgatgggactttttgtgt

SEQ ID NO: 382926 - DNA, 884 bp, Homo sapiens
ggacggcgtgggtcgacccacgcgtccggcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagcaaaaacaaacaagcaaaaaaaaacacacaaaaaaaacaaaaaacacagaagaggggggaggcagcaaagagaaataccacacaggggggcaccaaaaatacgaagatcacacgagaatacgtggaacaaaggggccacaaaaagaggacagcgcaaaaaaagcagaagagacacgagccgccgcgatataacaacacgaccgactaagaaggcggggaacaacaaagcggcaaccgagggacaccacttgcgggagaagacccccacacacacgcgggggagggcacaacgatggggcacaaccaacccgcagagcagattagcgcgaccaccagcggaacagacaacaacatcagagggacaaaaggga

SEQ ID NO: 382927 - DNA, 848 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggtctcttcccctgccccctcagttttccacttttggggttttttattgttattaaactgatgggactttttgtgt

SEQ ID NO: 382928 - DNA, 718 bp, Homo sapiens
gctgccgccggggcacgtgcgagcgtcgggcccctccctgcgccaccgcctccgggacggcgggtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382929 - DNA, 528 bp, Homo sapiens
ggatcccccccccgactagcccgacagggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382930 - DNA, 1011 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggtaagagatttcctggggggctggcgggggtggcagggtgaggggagcccggctcctgtcatcttggggtctggtctccttaatgtttaccctcccaccccatccagccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgt

SEQ ID NO: 382931 - DNA, 582 bp, Homo sapiens
gggggccctttacacattgatctccggctctctcacagacacacaacggatgacctacaccaatcatatacttttatatctcccccgggaccaacagatagggccctgtcggggtatacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggtctcttcccctgccccctcagttttccacttttggggttttttattgttattaaactgatgggactttttgtgt

SEQ ID NO: 382932 - DNA, 640 bp, Homo sapiens
  misc_feature (620)..(620): n is a, c, g, or t
  misc_feature (625)..(625): n is a, c, g, or t
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctccaggatccactcctctagnttganggccgcttctcgtgc

SEQ ID NO: 382933 - DNA, 688 bp, Homo sapiens
  misc_feature (9)..(9): n is a, c, g, or t
  misc_feature (14)..(14): n is a, c, g, or t
ggggccgcngtttngcggccggcccccgggcacgtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382934 - DNA, 905 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgt

SEQ ID NO: 382935 - DNA, 864 bp, Homo sapiens
ggcgccgctggagcctgctgcggagcgggagcctggttgatgctacaccctgatgccatgcctggctggtgctgttccctgtgagtgcgtgtgtgctgcatgtggatgtgtgtgccctgactgctctgcactgtgtgcccctgtgctgtgcctggccatggctggacatgctgtgcacctgctggtggtgtgctgctggctgtttgtgctgtgcccctgtgccccctgtgtgcctgtggcatgttgtgctgtgcccatgtgaccactgctgtctacatttcaagatgcacccccctgtgtggcctgcatgtgacgatgtgtgccctggtgctgtggggctggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgt

SEQ ID NO: 382936 - DNA, 1219 bp, Homo sapiens
  misc_feature (980)..(980): n is a, c, g, or t
  misc_feature (986)..(986): n is a, c, g, or t
  misc_feature (1059)..(1059): n is a, c, g, or t
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagcgtaccatgtctttngttttncctcatgaaaggctcaacccagcattttgtataggctatgtacaacaggcaaagttttgtattcaagaatttnacgttagctgcctcaatttatagctgtggtagtttgtccactggggtgtcaaatttgaagtctgtaggaaacagatctggggctcgagggtagatccagtctataggactgtctgattgtaaacatcagcaacacccagcaatatctccaatttcttttt

SEQ ID NO: 382937 - DNA, 765 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgagggtccccgacccaggagaacggtggctcccacaggacatcgtcggccgctgtggatcctatagagtcggg

SEQ ID NO: 382938 - DNA, 1072 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggtaagagatttcctggggggctggcgggggtggcagggtgaggggagcccggctcctgtcatcttggggtctggtctccttaatgtttaccctcccaccccatccagccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382939 - DNA, 888 bp, Homo sapiens
cggctgcagctcgggcggcggccgcgggggacaaagggcgggcggatcggcggggagggggcggggcgcggccaggccaagcccgggggctccgcaatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgaggccttcatttctggcctgctggacaagatccggggcatgcagaagctgagcacaccccagaagaagtgagggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagc

SEQ ID NO: 382940 - DNA, 344 bp, Homo sapiens
cgaactcctgacctcaggtagtccacctgcctcggcctcccaaagtgccaagattacaggcgtgagccaccacacccggccaagcctgttaaattaacaaatgctctggataatgagaccgggcacttggtaggcatcttaactcaaagataggatgtgttaagtaaaagaatgataattccaatctcaagaaccttctttaacatgcttaaaagaactaaccttttaagcgtttagaaaggtgaacacctgatatgctaattacagttcattcccatctattcctgaagccaggcctctagaatcaggcattatatagcccttctcaatagcatgtgaatacc

SEQ ID NO: 382941 - DNA, 335 bp, Homo sapiens
aaagccaaacctaagaaagtgactttgggtccagctggggcctgagggacaatcagggtcagggctggggatccagggtgtcctgcctgtgccagcccggaaaacaaggcacatcagcaccaagtcaccaaggccctccttctctcacaagctcccctccctgtgggctctttccccgcctgctggacccaggttccagctggaggggaggaagccactaagatgcagtgggggaaagtgatgccctcacaaacataataccacgacaccacaccccgggacaccccccagtcaccacccacagcctcccagtggcttcgtgggggatgtgggtt

SEQ ID NO: 382942 - DNA, 511 bp, Homo sapiens
agctattgaatacatttaagtagctaggaaacaaggtggtataggaaatagggaaaagaatagagaaagaaaatggttttaaagaattcttccctttggagtgaatttgaagcttcttgttctattttcaatgcaaaatctccaatattcaccttatagcaatacaaaaatagagtttggactacagaaaccacagttgtgcatatataaaatgttctcaataaatctttgcttattgagtcacagttacttccataataacttaagaaataaagagaatgcagatgcttcctaaagtgagcatatgggaaaatgggtaagttttgataactcttttattcaaggtttttcctccattatagaaataatatgctagaaataaagcatgtacctataatggagtaatttttttgagagaaattgaacacttttttttcttttaactaccttcttttattcacttgtactatcaggaatatccatatagacaaaaataaagcaagtttggggt

SEQ ID NO: 382943 - DNA, 429 bp, Homo sapiens
ctctaggttattagtatttggttcttctgatactaagctgagtgattttttttaaaacaatgtctctggtagtctgattgagatatgaaacttttgggaagaaaaccattatgtaacaagaatcctatgtaacaactgggtaaatgttttagaatgagagataggaaagaacatctaaatagtacttttttgtgggacgcatgagcctttatacagcctagctaatttgcaaggtaatgataaataaaagtgtattttgttactgtgcttaattcagaaattcaaattcatgtatttcctattggataatttgtaggcgggcagtttactttatagtcaggttagtttttgtgatccttagtgtttatatttgcattgcttttgtaataaggatgtatataagatcttaaacgcctttcaacttctgtt

SEQ ID NO: 382944 - DNA, 168 bp, Homo sapiens
ctgacatgctgtggtacacacttatagtcccagcgacttggaaagctgaggcaggaggattgcttgatcccaggagtttgaggtagtgtgcgatgatcgttcttgtgaatagccactagccactgaactccagcttgggcaacattgagacaccctgtctcttaattt

SEQ ID NO: 382945 - DNA, 385 bp, Homo sapiens
cccggatcctgcatgggttccagtaggccctcctgggacttggaagtgagctggtgtgctcggggttcatcagctccgtccagtcacctgactggcttttccttccactccaccatcccagcccagatgacaagggcacagtatggccttgtgacttgggaagtcctgggtaggttctctgtggctcacttcaagaggaggccagggtgacgcacagtgtacttcagagaccccagagccacctggacctgagtccctgtgaatggacacgtgacgggcctcactgggtgtgcagtaagataaaacatctccttaatctcagagagagcctgtgttaataagcacgtgcctggcctggcaccagatgcggcacagagaagagacg

SEQ ID NO: 382946 - DNA, 377 bp, Homo sapiens
ttcttccagagagtattgagttccacgagagaaaggcctttgttggttcactgctggattgctggtttctataatatttcatggcacatagtaaactgccaataaatatttgctgaatgaattcacttattcagaaaatatttattgagtgtctcttgtatgccacatatctaggcactgaggatagaacagtgaatgggccaaagtcctgactttttggaatttattttcaagtgggaagagagagattataaaatacgtgaccctgaaaatatatgtcatatgtctgatgttgatagtgccaagaagaaaaataaagcaggacaaggtgtggggagagagaattattatcctagctaaggaattaagtgaaggcc

SEQ ID NO: 382947 - DNA, 1109 bp, Homo sapiens
ggaaagagaagctatgggagagacaaagggaagtaaaaaatggttgttcggctcagcataacaatcacttttgtggggcttattggttgtgcataaatttcatccatttgggcacacacacagatgtgacacccagaccactcagacacttggctaacactgatgccgtcatcctgaatgttgtttctggaaggactttcatgaatagaatctatttcagattggccgtaagtctcgatttattgatccgcaccactggactggggtggggttgtgtccactttttccctgccccttccctgctttggctcttgtgattgtgtcctccgtgtgtcaggcagagccctgtgaaggtgtggatatgtggccatattttacctgcataatctgcagttcatatgattcagcctaatgggttgcaatgccctgaggacagagaccatactttttcttcctttgtctttttagcgaaattcaatcctgttctgcgcctgcgccacagttgcaggctgtactgtctgccctgtgcatctcacacacccccactgcactgtgcacctagtgatggccgcagatttgcttttactcatcttccagggcctaccctgttaattccatcacagttgcaggctgtactgtctgccctgtgcatctcacacacccccactgcactgtgcacctagtgatggccgcagatttgcttttactcatctgtttgcagggcctaccctgttaattccatcacagttgcaggctctactgtctgccctgtgcatgcatctcacacacccactggactgtgcacctagttgatgaccacagatttgctcttacccatctatttccagggcctgccactgttaattcctaggaaaaaagaaaaaacaagcatggtggattggttaaattggcattttatattgtttgtgttcatgccatgccaatgataaacaagagctggtcatgggcattcagatcagatgagcaattaaatcccctccaaaaaacagaaacctacttttagagaagaaaagaattaaaccaagatctttcagggttttgcttctccttttgtttttaaggcacttaaataaatggaagaacatgta

SEQ ID NO: 382948 - DNA, 407 bp, Homo sapiens
tcaaaaaaaaaaaaaaaaaaaggaaatctttcctttcagccaagcaaaatgatcgttagatattatccactcttaaaggttagcctaggttctgaataaagaactagaagccggctgggtacagtggctcatgcctgttaatcccagtactttgggaggccaaggcgggcagagcacctgaggtcaggagttcaagaccagcctggccaatgtagtgaaaccccgtctctactaaaaaaatacaaaaattagctgggcgtggcggtgtgcgcctgtaatcccaactactagggaggctgaggcaggagaattgcttgaacccaggaggtggaggttgcaatgagccaagatcgcgccattacactccagcctggggaacaggagcaaaactccgtctcaaaaaaaga

SEQ ID NO: 382949 - DNA, 695 bp, Homo sapiens
  misc_feature (688)..(688): n is a, c, g, or t
  misc_feature (691)..(695): n is a, c, g, or t
catggctatgactgaaatcaatgttgggaagctaatgttttcatgactagcattctctctctgttcaagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaattagtgggatccctgaaatctattccaactatgtgcttccaagtcacatgactcaataaatgcttcagctggttgagttgtgcttggcgttcactaccaggagagttctgattaataaaaactcattccatcaattaataatttagtagctctctttcaacctgagccaaattcaagcataagctaaaggataagcagtgacccatggccaatttcctatgtcatacacttgccattagtgacgtaagttaagccattcttcaaaacattaaacagccttcaagaacaanaannnnn

SEQ ID NO: 382950 - DNA, 7037 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctgcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccac

SEQ ID NO: 382951 - DNA, 7437 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaa

SEQ ID NO: 382952 - DNA, 6985 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgaataatggcagtgagtggcttttttcattgcaaggatgaggaggatatgcttttctggctgtatggcgggaccacccatctcaaaaagtgcaaaaatatttaatttagt

SEQ ID NO: 382953 - DNA, 7250 bp, Homo sapiens
  misc_feature (3751)..(3751): n is a, c, g, or t
  misc_feature (3787)..(3787): n is a, c, g, or t
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccagaatacactctggctcacttggagcccccagactccctggaagctgcagaggctgggatccggaagtttgaggatttctggttgctgaggatggntactggctggaatgccctgggcaggatgtgggaganccgcagccacaccctcgctcagtgccttggcttccaggagttccagaaagatgccaagcaggctgaagccatcctcagcaaccgaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctgcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccac

SEQ ID NO: 382954 - DNA, 1220 bp, Homo sapiens
agaaggaatacataaaatgttaataatagctaattttttgtaatgaaattacatgcagatgattttttaacaataaaacatgttactatgtatcagaacaaacatggtgtaattttttttaatggtgaagctataggaattgactctagagataccatatcaggatgtgggtgacctgcctgtctgcatctttgcaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggtgaggccttcctggcctttgaaagctcgggttgatggcttgatttggcattagtggcagggcagaggccctctgtaggggaccagtgccaggcctgagctgctcctcaggggtttttcaaatcaaagaggctgatggtccagactttgacctctcagaaagtgctgggctgcctgagaggggtctggatgttcggctcagggtattgtgggatcagagccagccctctgcccagcgccccctccagaggtgtctccatgacaggaaaccctttgtcctcctaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaa

SEQ ID NO: 382955 - DNA, 1316 bp, Homo sapiens
tcgcccaggctagagtacaagtggcaagatctcagctcactgcaacctccacctcctgggtttttgcgattcttctgcctcagccacttggtaggctgagatgggaggatcacttgaacccaggaggctgaggctgccatgagccataatcacatcactgcactccagcctgggtgacagattgaagccctccctctaaaaaaatataactattgtgaagatcggttaggggcccagtgtcggaatggggtggctgcaggcagcaagcgtatccatgtggtttagggacacctattcaggccacctgcctgaccactggccccaatcaggagtgaacgattgggtgctaacaggccctgggccttgtggggggtctgtgtcctgttccccctggcagtgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctgcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccac

SEQ ID NO: 382956 - DNA, 6987 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctgcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacactagccagagatgattagtgcatttctgtacaccgtccttttccccattttccaactccttcctctaggcagtactcaccccctgcacccacacctacacacaggcacatgcccacacacacatgcatgcacacacaaatacacacccacatgcacacacaccacacacccccatatatacagacacctcacgcacaaccacacacccacatacacatacacacacacatacacatacacacaaacacaccacacccacccacatgcacccac

SEQ ID NO: 382957 - DNA, 7721 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggacgttcacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggtgaggccttcctggcctttgaaagctcgggttgatggcttgatttggcattagtggcagggcagaggccctctgtaggggaccagtgccaggcctgagctgctcctcaggggtttttcaaatcaaagaggctgatggtccagactttgacctctcagaaagtgctgggctgcctgagaggggtctggatgttcggctcagggtattgtgggatcagagccagccctctgcccagcgccccctccagaggtgtctccatgacaggaaaccctttgtcctcctaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaa

SEQ ID NO: 382958 - DNA, 5587 bp, Homo sapiens
cgccacccccgggctcgggtggccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaatagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccatgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgggtatcggcgggagctggccctgagaaatgagctcattcggcaggagaagctagagcaactagcccggcgctttgaccggaaggccgcaatgagagagacctggctcaatgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatgagccacttggagcagtgctttgaggagctgagcaacatggcagctggcgcaaggacccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcatcaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacacactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctgggatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcggaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaatgaggcacagcagtactacctggatgcggacgaggctgaggcctggattggcgagcaggagctctatgtcatctccgatgagatccccaaggatgaagagggcgccatcgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggccctattaacgaaaaagtctctctagcttgtccgaggatattgggtttgtattctatct

SEQ ID NO: 382959 - DNA, 392 bp, Homo sapiens
tccattatattcaactgtttctcaaaccacatggccttccaaactcttcattattttggttattttctctctagaaagactccagtttgagtagatattagaacctattgaaacaatttgttctttttttttctgggcactgtgcttttattaatgcagcctaagattaccttagttttggcagccagattgcaccaacgactcacactgatttatcttttaagtgtagtttttaaatttatttttgtgtgaattttttactggtttcctccattctgtgctttccagctatgttctctctttttttttaatccaagtataggtgtttacatttttactgtaacagtgtgatgattttggtccattttttcatcctgttgaaatattgctat

SEQ ID NO: 382960 - DNA, 1104 bp, Homo sapiens
tcccatccccaccctgcacattcctagccctttgcagaatttgtcccaccccctggtcccctgttcaccccttgtagcaacccctgtttgaagctcctgggctgggctctgctggcctaggtgggtcctcctcacccttcactgagcctccctgaagcagaggggaaactgaggcactgaggggacatgtgacttccctgagaggcagagctgggactggaacccaggtgtgtttcaggaaggagctgtgggctttgagggaggaggcctgggtccccacagtccccccctcaagcctcagtgtccttatatgcaaaccagcagtcacagtggtgaccttttctgtgcatcctccctcaatgaagcagtgagcactgaagaccaggaacagggcctggtgcgggcggggtccacctgctgctgctctctgtgcttgcgactcatggcaacacagttaattgaatgctctggcctcttgcgtgctgtgcccgggggctggtctcccactgggctcaggtccagttcctgatctgggtctccgggtcccatcctgcgaggggacaggcccagctccgggtgacgggggctgtagtggaggcagtactaggtgccagaactgcaggctccttggcgggggctgacaccagcgaggggatcttttctgtagcgcagtggccacattgataaggcagtaacagctgattatctcagccctcacagagaccctgttatccgccccatttttcagaaggggagactgaggcctagggaagcaaaacctcttgctcatagtttgtcagcggcagaggtctgattggaacatgactgaaaccccagcccagatcctcagacatgagacggtgcactcagccttaatggctagcaggcaacagcacttccactgtgtaggaagcaatgtcctaggccaagaaggggagagggagaggggcaggtaggcttcgtggaggaggtgtctgaaccgggtagaagggttcctacgtggagcaagacggggaggggcactgctggcagtgggcatcgcagggcacaggtggcagggcagggacgtgctagaagtgggcttggagcccgggtgcacccctg

SEQ ID NO: 382961 - DNA, 193 bp, Homo sapiens
ctcagtgggaattctataaatttgatttcatgcctccaaagtcattccatagccctttttaaggcagacctctctctgttgtgtcagggtgctgtgggacattgtctttaagattttagaaaactttagtttaattgagaggggctaactaggtactctgttaaatctttctgaggttttaactaaaggtctt

SEQ ID NO: 382962 - DNA, 281 bp, Homo sapiens
catgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacg

SEQ ID NO: 382963 - DNA, 271 bp, Homo sapiens
ccactaccattttgcactaaagtacaagtgcagattaagtgagttattcagttggttgcaacagcataccactacaggggtagctggtcttctaaacagagcttgggatattactttacttacatttttttttttttttgaaacagggtctcactctgtcacctaggctgcagtgcagtggtacaatcacagttcactgcagccttgacctcttgggctcaagcaatcttcctgccttagcctcctgagtagctgggactacaggtgagcc

SEQ ID NO: 382964 - DNA, 407 bp, Homo sapiens
aactaaagaaagaaatcttagtgaattgaaatttcaaaggctcgtggtgataatattttctagcaaagcaaggtttggtatttcaataaagcaagacttagtggttcatgagtaaaatgcatatgcttttgtgcaactttttcaagaaaatgtaatggaaataaacgtctgcagtgtgttttgggtgctgtagttaaacagtccacgtgtatttgactgcagtagttgtactgtgtgcagttctattatttctaagtgaatctgtggtaaaaacacccttattccaagatctaaactatataatctgtgttgttttatttccacttgaattcgttgtcatttttcacttttaatgtttgaactactgccttttctacaaaaaaaaaagcattggggagaaatcgtta

SEQ ID NO: 382965 - DNA, 743 bp, Homo sapiens
tcaggcaagagtggagcacagaggaaaggggtgtctttctcaagagagaagcaaactgcgggtcaaagtgcaccaccagccaccaacagctagcttccggatcaagtaggatggaaatggtttattcctccaaagactcttaaaagagcagcccctgctgcagaatagaaagaggctccagaggagcagtgagctcgaggaacccccctgaagatccccagtttctgtatgcagctgcatcaggcccagacaaattcttccatctggggcgtgtccccgcagatcttcccagccgcggctgtggtccgcgttatctcaggctgtcaggtctcagaaattagaaaccatctcatttcatcagggtcatccccacaccgtctgccaccatagatgggagaggatttcaagtgatgttttctgaagatggttctgttgtcccgggagagcccttggcggacatggtagtgccagtcagagcccttgacgctgtgcagccaggtggcttattgtcccagtgactttccaaccagatactctcagtcagagtgaagggctccacttagaaactccctttcccattaactcgtcagagttatgccattcctctttattctttttaaaatatttatactcaaagaaattgtatggggagtgagcacacaccaatcatataactgtcaaatgaaagcctttccttaaatgttcaagggcgccggaggaataaatttggagtcatgcagatc

SEQ ID NO: 382966 - DNA, 758 bp, Homo sapiens
tcacgacaataagctcaataaagattgaacacgacccaccgacatcccgctcttgtgagtatatagcaaactgcgggtcaaagtgcaccaccagccaccaacagctagcttccggatcaagtaggatggaaatggtttattcctccaaagactcttaaaagagcagcccctgctgcagaatagaaagaggctccagaggagcagtgagctcgaggaacccccctgaagatccccagtttctgtatgcagctgcatcaggcccagacaaattcttccatctggggcgtgtccccgcagatcttcccagccgcggctgtggtccgcgttatctcaggctgtcaggtctcagaaattagaaaccatctcatttcatcagggtcatccccacaccgtctgccaccatagatgggagaggatttcaagtgatgttttctgaagatggttctgttgtcccgggagagcccttggcggacatggtagtgccagtcagagcccttgacgctgtgcagccaggtggcttattgtcccagtgactttccaaccagatactctcagtcagagtgaagggctccacttagaaactccctttcccattaactcgtcagagttatgccattcctctttattctttttaaaatatttatactcaaagaaattgtatggggagtgagcacacaccaatcatataactgtcaaatgaaagcctttccttaaatgttcaagggcgccggaggaataaatttggagtcatgcagatc

SEQ ID NO: 382967 - DNA, 395 bp, Homo sapiens
ccaccaaatctggtacagttctgctgttttctaatggcaatgggtatttttattttgccttagtagatgttgtggtaaagatgatggaaaagtatgtcacctgaaatgaagaataggcatttaaaaaataataaggcatagtgtgcagaagtgtgggtaaggtgagagatgcgttaggcaattgggctggagattcagagcccagggtggtttgagctctgtgtggatgggaatcatgactccatccagcctgtcttcagagggttgttgctcttgccataaccctcctggtacctggcatggaggcatcagtctcctttagcttttatcaagaaaccaaaaaggcagctaacagtatgaaaagctgttcagcttcactcagaatgaaagaaatg

SEQ ID NO: 382968 - DNA, 936 bp, Homo sapiens
ctgcactctagcctgggtgatagaacaagaccctgtctcttaaaaaaaaaaaatgtattatgcaccaggtacaatgtgctaggtactggggagagatcttaaaaaaatgtattatacaccaggtacaatgtgctaggtgctggggagagatcaggggataaagcagagcaaaatttctgtcctcatggagcttgtggtctaaaggaggaaaaaaggcaataaacaaattaaaaaagaggaatacaaagtatgtgggtagggatgagtacaacagaggaaaatcaagcaggaaagatagaactctggaaagaagtagggccagtgtcaaataggatggccagggaatgccacactgagaaggtgacaccaaagcaaagacctacaggaggtgaagtggtgagccattcaggtcactaaaggaggcatgttcccaggagaggggacgacaatgcaaaggcaagaaggagcaccagcctgtgtgttgagaaaagcatggggacccaagcagctaaagtggaacacatgtaagaagaataaccgtaatgaggtctgagagacaactgggtgggaagtgtcttaatctgtttgtgttactataaaggaatatctgagtctgggtgatttataaagaaaaggaggtttgtttaggtcacaattctataggctgtacaaaaatcagcaccagtatctacatcaggtaaaggctggaggttgcttccactcatggcaaaaggggaagaggagccagtgtgtgcagaaatcacagggtgagagaggaagcaagagagagagggaagcaccgggctcttttaaaaaaccagctcttgggaaaactaatagagaactcactcactactctcaccatggcagggcattaatctatttatgagggatccatccttatgatccaaacacctcccactaaacccgacttcc

SEQ ID NO: 382969 - DNA, 357 bp, Homo sapiens
aaattaaaatgtcagtgtccacaaataaagttttaattggaacagagccatgatctttcaattacaggttgtctatagctgctttcgtactattacagctccgccaagcctgcaatgtttgccacctagccctttacagaagaagcatgctgaacccgggactagagcatctctctatgctcctggttgcattgcctttctcagaggcactgcttcacaaggttgagccttcaagcttgacaggtgtccatctcaggactgtgtcatccaaagttacattaataaaatcataggatttagtgtaattcattagggtgggtacaaagacaaagtaacatattacctgcacacataagg

SEQ ID NO: 382970 - DNA, 1184 bp, Homo sapiens
gccaaccctcttaagacaaataagccctcctgatccttgggaccatcagacatttaggatctaatgcttgaaagtgttgcttcgcttgttagatgttggatgccatctgttcaaatccaaatgctctccttctctgatgttgattattatttactgtggggagagcgtaataaaatagactcttcccctggctgcctttggacaagccccaagagtggcacctggtaccgtttttgatttttcattttccttgatggagctgtcacatctgggagatcatggatagattgcacatatttatcaaacgtgtggaagatggctgtaattttacaagaaaatttatctgtctccagaaagttcccattctaaaagactatttttatcccaacaaggaatgtcctgcattgatcttgttcttctcttggtgttgcacacgctgcctttcctatgcctttctcatctatttgttttaaaatggtcagttggatcagtcttctgcatctgaaaatgcacattccctgtctcagtgtgaaggaaaagcagatttcagtgagatatttcatttcctttcaagaatattgttttaagtgccaagtgaaattacgcatgctgagaatattagaacctagcaaggctggtcagaaaatgatgtcagaggcctttggtggaaattagagaagggggaagtggtgcatttggttgattagttagaagaataacaatgactaaaacctactatcaggttggggggcgggtcaccaaacaagactagaagagacaaaacctccactgtgactgtgggcccactgtgccaaataaatgaactgttaaactttcctgttcccctgccagttgtgtagaatagagtaaaaactgaccccaacacagaaccttggcctgggccagctactactaaccccacgacatgaaagctttattgacagtcggaaggcagcccatttgccctaccaaaccttcatagaaaaagtaaacataaggaaacctaccaaacatttcaaacattcctaagtgtcagccctattaactttgatgttcgtttggttattactacaaatccccacgtttatttcttttcaagagaaagttgttcgaaatgtgaacgttttccatctttacctgactggccaggagtaatcttataaaaatttgaaatttactcaaaa

SEQ ID NO: 382971 - DNA, 274 bp, Homo sapiens
gccaaccctcttaagacaaataagccctcctgatccttgggaccatcagacatttaggatctaatgcttgaaagtgttgcttcgcttgttagatgttggatgccatctgttccatttctataactttgtcatttcaaaaatgttattaattggaatcgtacagtatatggcctttggagattgactcccctccccctgcgcagcatcattaaggcttattaccttttggttaaaatgaatttctgttgttagtgaatagtttggccttgtgctt

SEQ ID NO: 382972 - DNA, 295 bp, Homo sapiens
gtggcacacagataaagcagtacatcagagggacctttatagctcggtgctcaagctagaataggagtaaaaaaattaaagagtgcctacctgaacaagtcagggagagaagaacaaagtaagctcaaagaaaacagaaaaagggaactagtaagaaattcaacctgtattaattacatataacggcaggtacacaaagataaacattggttctttgaaaagacaatgcagtgaaccagtgatctctggcaagactcatggaaacacagaaagggaacacaagagaaaaagccca

SEQ ID NO: 382973 - DNA, 347 bp, Homo sapiens
ctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaa

SEQ ID NO: 382974 - DNA, 744 bp, Homo sapiens
ataatgtgagaaggagaggtgctttttattggatgtttctggaaaaacgttagtttgttatgagttacaggtctcaaacaatgtgtactgctttgcaaactactcttggaagaaggaacagcttgtcctctactggcaccatagtgtatctgcatttacattttccctgtcgtgcatgagcacctcttgggcacaatctgagatgcactttcagaacaccctaagatgaacttttcaagtttatttaaaaaccaacaacaacagcaaacaactccattggggttgtcaggaaactattaacatctccttggattatgagcgttgattttcagaacacagttgggaagtgctacactagaatattaatgtccttatccctaattttactttttagtctaaaaacataactagcttataaacttaattttgtttctaatgtactagctttttttttttagttaattcaattgtcagtaacttctactttaaaagcagcaaatttacactcataataatgtcactttcctctctcacttaaaacaatagttgaaatcaaattgtgtttcagcacaaactggactctgactctgtctaaagtcctgagctttggcacctactgagtaatcattcaatgtttgtattcagccaaggtcctaaatccttgagttaaaaaaccactccactttggctagagtccctggcttcttttgaattcaaaagattctgatgtttctataagattca

SEQ ID NO: 382975 - DNA, 860 bp, Homo sapiens
gattttttaggtttaggtgttgacagtagctctcacctcagcctgttctctctccttgtcatgcagcccacaggggagatggtcaggccagtgtgggggctaatgaataaatgctacactgtgcccactcaggtgggtaagggctggcactcctcttcccctggagtggggcggctgtgctggcacccttggcagacacagtaagggggactgcacctggaaaggatgggccagtcggggcaggactactcatcactcatagtgtgggtgtcagggttgtgtcacccctcccacctccctctgcagagacgcaaagtcaagagtaggaagaagccaacctctgaggtaaggcttcccctggaaggcccagggctggggctctctcctttcagagctcagttagacccagacacacggcagggagtcccaagggtagtggcaggccccctccaggaaactcacaaggttaccacagctcaactgaaaaggaagaacttcccaggactgtgacaccccagtgtgagaacaggaggatgaggtgctctgaaggcctttctgcccagtctgccctcttattcctcctgcaggtcacgacccccaggagacctggaggactgaatgctgctgcccccaaggaggaggctgccgtcttatcccaggagggagagcagaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgcta

SEQ ID NO: 382976 - DNA, 639 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcagactcacctaggctggaggttgcggtgagccaagattgcgccgctggactccagtctgggcgacagagtgagaccctgtctcaaaagg

SEQ ID NO: 382977 - DNA, 2037 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgaggtaactgctgaggcagataatggcgcctgggctgcggtggggcttgtcctgccgcctggcggctttctgcagggccaggatatacttacttttctgtaaaccaactcttccttagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgcccagcccagcccattatgtcggtgaggacagacgtggaggacagcagtccctgcccttggttggggctccaggccagcaagggccacagcccagaaggcagagcaggaagacaggactcggggcaggcagcctggcctgagtggactcgcctggtcggggccagacagagctcctggggccaaagggccgctgggtggtggagggcacggggggccgcaaaggcaggcattgggccttgacctccccgggggaccttggtggggcacccccgggaag

SEQ ID NO: 382978 - DNA, 2406 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgcccagcccagcccattatgtcggtgaggacagacgtggaggacagcagtccctgcccttggttggggctccaggccagcaagggccacagcccagaaggcagagcaggaagacaggactcggggcaggccagcctggccctgagtgcgaactcgtcactggtcaggggtccagacagcagcatccctgagggcccagagaggtggccagtcctgtggtgaggttgagaggtgtcaacgtgctggtggtcctcgctcgctctcagcgcctcctcggcctcagcttctgctctgaccacacttgaggagcccttcagcccagcgctgcactgtgggagcccctctctggactggtggaggctggagccggctccgtctgcttgcggggaggtatggagggagaggcgtgtgcgggaacctgggttgctcgcgggccagcaccagttctgggtgggcaggggctcagcgggccctgcactcggagcggccggctggtgcctctggccccaggcagtgaggggcttagcacctgggccagcagctgcagagggggcaccgggtcccccagtactgctggcctgccggcgctcaccacacttgaattgtcgccaggcctcagtcacctccccgcggggcagggctcaggacttgcagcctgccatgcccaagcctccctacggtgggctccctgcgaggcccgagcctcccggatgggtgcctcccactgctccacggcacctggtcccgtccactgcccaagggct

SEQ ID NO: 382979 - DNA, 1957 bp, Homo sapiens
gattttttaggtttaggtgttgacagtagctctcacctcagcctgttctctctccttgtcatgcagcccacaggggagatggtcaggccagtgtgggggctaatgaataaatgctacactgtgcccactcaggtgggtaagggctggcactcctcttcccctggagtggggcggctgtgctggcacccttggcagacacagtaagggggactgcacctggaaaggatgggccagtcggggcaggactactcatcactcatagtgtgggtgtcagggttgtgtcacccctcccacctccctctgcagagacgcaaagtcaagagtaggaagaagccaacctctgaggtaaggcttcccctggaaggcccagggctggggctctctcctttcagagctcagttagacccagacacacggcagggagtcccaagggtagtggcaggccccctccaggaaactcacaaggttaccacagctcaactgaaaaggaagaacttcccaggactgtgacaccccagtgtgagaacaggaggatgaggtgctctgaaggcctttctgcccagtctgccctcttattcctcctgcaggtcacgacccccaggagacctggaggactgaatgctgctgcccccaaggaggaggctgccgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgcccagcccagcccattatgtcggtgaggacagacgtggaggacagcagtccctgcccttggttggggctccaggccagcaagggccacagcccagaaggcagagcaggaagacaggactcggggcaggcagcctggcctgagtggactcgcctggtcggggccagacagagctcctggggccaaagggccgctgggtggtggagggcacggggggccgcaaaggcaggcattgggccttgacctccccgggggaccttggtggggcacccccgggaag

SEQ ID NO: 382980 - DNA, 1222 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgcta

SEQ ID NO: 382981 - DNA, 825 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcagaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgcta

SEQ ID NO: 382982 - DNA, 871 bp, Homo sapiens
tggggaagggtggggaagggtgggcccggggtcacacggggtaatggcagagcaaggactagggtcagggtctctggctctcagctgcccatgccacctcctccttctctgcccgccccagtgccttatgggtccaaggttgactcctgtccctagggcaggcctgtgggccctgcctgatccctactgggaggatggtacctagggttggagccaaacaagtgtcctcctccagcgccagcctggccctgagtgcgaactcgtcactggtcaggggtccagacagcagcatccctgagggcccagagaggtggccagtcctgtggtgaggttgagaggtgtcaacgtgctggtggtcctcgctcgctctcagcgcctcctcggcctcagcttctgctctgaccacacttgaggagcccttcagcccagcgctgcactgtgggagcccctctctggactggtggaggctggagccggctccgtctgcttgcggggaggtatggagggagaggcgtgtgcgggaacctgggttgctcgcgggccagcaccagttctgggtgggcaggggctcagcgggccctgcactcggagcggccggctggtgcctctggccccaggcagtgaggggcttagcacctgggccagcagctgcagagggggcaccgggtcccccagtactgctggcctgccggcgctcaccacacttgaattgtcgccaggcctcagtcacctccccgcggggcagggctcaggacttgcagcctgccatgcccaagcctccctacggtgggctccctgcgaggcccgagcctcccggatgggtgcctcccactgctccacggcacctggtcccgtccactgcccaagggct

SEQ ID NO: 382983 - DNA, 1922 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgcccagcccagcccattatgtcggtgaggacagacgtggaggacagcagtccctgcccttggttggggctccaggccagcaagggccacagcccagaaggcagagcaggaagacaggactcggggcaggcagcctggcctgagtggactcgcctggtcggggccagacagagctcctggggccaaagggccgctgggtggtggagggcacggggggccgcaaaggcaggcattgggccttgacctccccgggggaccttggtggggcacccccgggaag

SEQ ID NO: 382984 - DNA, 2009 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcaggtcacgacccccaggagacctggaggactgaatgctgctgcccccaaggaggaggctgccgtcttatcccaggagggagagcagaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgcccagcccagcccattatgtcggtgaggacagacgtggaggacagcagtccctgcccttggttggggctccaggccagcaagggccacagcccagaaggcagagcaggaagacaggactcggggcaggccagcctggccctgagtgcgaactcgtcactggtcaggggtccagacagcagcatccctgagggcccagagaggtggccagtcctgtggtgaggttgagaggtgtcaacgtgctggtggtcctcgctcgctctcagcgcctcctcggcctcagcttctgctctgaccacacttgaggagcccttcagcccagcgctgcactgtgggagcccctctctggactggtggaggctggagccggctccgtctgcttgcggggaggtatggagggagaggcgtgtgcgggaacctgggttgctcgcgggccagcaccagttctgggtgggcaggggctcagcgggccctgcactcggagcggccggctggtgcctctggccccaggcagtgaggggcttagcacctgggccagcagctgcagagggggcaccgggtcccccagtactgctggcctgccggcgctcaccacacttgaattgtcgccaggcctcagtcacctccccgcggggcagggctcaggacttgcagcctgccatgcccaagcctccctacggtgggctccctgcgaggcccgagcctcccggatgggtgcctcccactgctccacggcacctggtcccgtccactgcccaagggct

SEQ ID NO: 382985 - DNA, 721 bp, Homo sapiens
atgctcatctacagaaacgccgcttggcctttggactacaccatctgtcgctcgctctaacgagccggcgttgcctgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgaggtaactgctgaggcagataatggcgcctgggctgcggtggggcttgtcctgccgcctggcggctttctgcagggccaggatatacttacttttctgtaaaccaactcttccttagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcagagtgagactcacctaggctggactgcaatggtgcaatctcggctcactgcaacc

SEQ ID NO: 382986 - DNA, 172 bp, Homo sapiens
agcctcatcctatctatctacaaaggtcacaaggatctccctttcctgaaggctcctctcctcatttgtgttaagtcagtccaggctgttacagaacactgaagggtctcaacaaatatgtaaagtaacagccctggatttcagtatcagaatggcaatgtcttaatatttc

SEQ ID NO: 382987 - DNA, 334 bp, Homo sapiens
gaaaaaactaaaaggcagaaatgaaatccacaagcagacagcccagcgccacaccctgggcctggtagttaaagatcgacccctgacctaatcggttatgttatctatagattacagacattgtatagaaaagcactgtgaaaatccctgtcctgttttgttcttaattgccagggcatgcagcccccagtcacacacctgcttcttgctcaatcgatcacgaccctctcatgcgcacccccttagagatgtgagcccttaaaagggacaggaattgctcacttaaggagcttcgctcttgagacaggagtcttgctgatgcccccagccgaat

SEQ ID NO: 382988 - DNA, 364 bp, Homo sapiens
atttcatatacattaacacaaattagggcaacagtcctataaggtggacattatcctcattttttagatgaagaaaccagtgcttagaaagaatatacacttgtaacaggtagggcaaggactgtaacacagacttgtctggcttcagagactagaggctttgtagaaagctaccttgcctctgcaaaaggataaactgctaaaacataaacttcatgaaataaaaccaaaatcagtaaactggagggagacccctgtgtcctgggactattgcctctaactagcagcatgaccctgggcacatcttttgggtttcagtttctttgtctatgaaatgacagtgtcagatccaattgtttcttcc

SEQ ID NO: 382989 - DNA, 154 bp, Homo sapiens
tggcagcctgagctgatgaataaaacaggtgagtatgtggggatatcccctccattgttgtgtcttcattccagttctgagtcaggagattctcggaatttcctgggagtaacagttccatccaagttacaagttgcgttaggagaaagaaaag

SEQ ID NO: 382990 - DNA, 156 bp, Homo sapiens
gattaaataagacacagataaatagaaaggcatcctgtgtttccaaattggaatgcttaatattgttaagatgtccaaactatctaaagcaatcagcagattcaatgcaatccttatcaaactattaatatctttttttcaggaataaaaaaaaaa

SEQ ID NO: 382991 - DNA, 531 bp, Homo sapiens
tggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagt

SEQ ID NO: 382992 - DNA, 876 bp, Homo sapiens
cccagctactcaggaggctgaggcacgagaatcgcttgagtctgggaggcagagggtgcagcaggccaagatcatgccactgcactatagccttggtgacagagtgagactctgtctcaaaataataacaataaataaagttatattttaacaaaaggattgacaaccaaaaaccatgcttgtttcaagcaatatgtattaataatataataaaaatgcaaatacaactataaagtgagaatactatttggagttcaaaacagtaatgtctgacctatatgtaacacaactgaaatataaagcatctttcctcctgggcatgttgtttccgcagaagtgtggcctctgaagaaaaatgaaaataaaagaagctgacctaataattctagagtgatttcacctgatgaactgtttcaaagtaagcagataaaaatccaagtgagtgaaaacaaatccaatttgtaacaaaaatgttaaaaacctgatacttttaagctgaagtcttttcctggtccttcatttatttaccttcaaggtttctgaactaatcttgagatattttagaatcaaatatctgattttaacagatatgtgactggtctaatacatagctgataactactaagtaacggagtaactaaggtaaaacacaattctctctggatttgtttcaaatttcttctcctgaagacacgtgacatacaattcacgatgtgactttgagtttggggcagcgtttgcaaactgcggttcacaggccaaattcaacccactgtgaaagttgaaaaacaatcaaaataagactattttgtgacgtgaaaattacataaaattcaaatattgttgtccataaataaaattttattggaacacagc

SEQ ID NO: 382993 - DNA, 913 bp, Homo sapiens
ggttttaaatgcggagtcatctcttgatttgtcagcgaggctttgactgtgagcttcgcggcgttcgcgcctcaccgcctcaccgaggtgggtacgctgcgaagactaggcttatgttacccagaggttagtcctctactaggccacgtactttaaataatttatcacgctagtggaaatgcggggtggaagaaaaccccaccagcctttggattgtaacagcacagtaactttccctggtttttaaaaatattgccaaaatactgcgactccatgtggccaacgtatagtgactgatcactttgaaatgcatgcccttgacccaccaactcgcatggcctctcgctataagagagcaagccggctgtgttccatgttcaattcaataagtgcaattcaataagcttttgacttgttctgcccaagcaaatcctgcctttatatcgaccttgcaagcagaacagagaatgctgtttggaaggcagaattcatagtacctagttttcttgtccctgggaattttgagggacttgaaatgtcgcgtggatgagtgagggagtttgtcttccagagacaaagcaaaacgaaacgtcaaagttctgtgctggtgaaaccagatttgaagaatatcaaaggcgtcttaccaaagaggaaaaaaaatgcatcttgccaagacttgaagaaagggattagagaaaccagaggccttgaatactcagaaaatgggagattgtgaatgggtgtagaggatatctatgaaccttgacatttcttttcacgccaagtccattcccctgttaacagttgcttcccagtttcctgcacagctgcatggtctgggacacttaaagaaaaaaatcacaggaaatcagtgttcttggtatattatataaagttatgattctatcaacat

SEQ ID NO: 382994 - DNA, 537 bp, Homo sapiens
taattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgctgattggcaaggtggttagagctgtgtattgagaggtcttctccaaggtatcagttttcctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctg

SEQ ID NO: 382995 - DNA, 355 bp, Homo sapiens
gaggggtgtacaaggagaactgtggctaaaaatgtccaacaaatagaatgcctttcatctcttattttctctatctctttcttaatccatgtcatttctcattaaaatgtacttggaaatttatcatcagagagctttatcttcccatgccagaaaaggcatgtgtcctagtggaagaggataatccccttttctgttcttctttggggctggtttaatacccagacttcacggagaattgatggatcagagctcgatgcagggagattagttagctttctaagaagcgaatacttcctgatcacaaagaggcaaaagctccctagacccaatggttttatacaggttttttacc

SEQ ID NO: 382996 - DNA, 406 bp, Homo sapiens
gctttaaaaaatcctgctccctagctgggtgcagtggtttatgcctgtagccccagctacttgagaggctgaggtgggaggattgctcaagcccaggagtttgaggctgcagtgagccatgaatgtaccactacactccagcctgggcaacagagcaagaccccaactctaaaaaaaaatcctgctccccaggtgacagtatctgggggaaggagtaaggcatcttattttcaaaagatcataagaaaagaggctcattgctgaggctcactccggagcccacttggattcttcacaagaaagtttccctcttccagaattttataattgagggaaccgactagggaaagattaatttgcccaaggtcaaacaactagtaaaagaagtaaggattccaacccagat

SEQ ID NO: 382997 - DNA, 251 bp, Homo sapiens
aaccatttcaagcttatagaaaagctacacaaacagcacagaaaggtcctgctggcctttacctgagatgcccgtctgcctttaactggttgtctcagtgttgtttactacagaaggtccaatctaggagcaaatgctgtacccaggcattatgtctctctggtctctgcaatctggaacattcttcctcctttccttggttttcatgaccttgacattttggaagattacagggcagtcattttgtagaa

SEQ ID NO: 382998 - DNA, 353 bp, Homo sapiens
gactgcacacctgtgtaccttcatgtcctgaaaagatcttttgacataggggctaggtataatacatttcatctattcatttcaaaatgaacatcggtcataagttacatgtatgtttatctaacatgcctgtgtcaggaccactttcttgaatactcagctcctcctgtaacttgttgaacatgtatgtttagccaaccttttcagcataaaactcctaccccaacccctcctccttccaaacgcctgtctctggtcttggctagaggcaggcttcccagcctgtgggacaaccaccttgcaggctgtaaccttttataagaattaaagcctcttctcttctaaatttataa

SEQ ID NO: 382999 - DNA, 480 bp, Homo sapiens
aatgaggaaaaaaaagaaagatgaaacttcagaagacagtccgtatttgaataatctttagaagaacatctgtattttgaaaagaaaattatcatatgcctcttaaaactgcaatttttcaaagttgaaaatatgtctctctctaattgaaatattaatagagtaccggtagtcagagttctttccaatttctgaactgaaattatgattttaaaacaaccaccaccaagctcttagagggtgatgactgtagcttaaaattttgtgactattgtgatcattgttaactttcataccaaatgtattgtttctctaagaatttttgacaatgagtgggtttactacatatacgtagttcctgttcttctcgggttttgtttgtttgtttgtttgtttactgcatatgaaacatcccaacacaaaaaagggattaattgacgtttctgtaattaaaactagtttttgcatttaagcttaaaa

SEQ ID NO: 383000 - DNA, 386 bp, Homo sapiens
atgagacaatgcatgcccacacaggtgagagccaccagagttcagagaaagagtgaaataaccaagcacagagaataaaggacacaaagtgcatctcgtgctttcttcttcagtcccacaagtctaggtgaggtcagcctcccactgcctcccgtaaagctgtggattttcctagacagccaattgtactatttcttcttccctccctctcctcctttcttccttccttccttccttccttccttccttccttcctttcttcctcccttccttttttattttttggcagggtctcactctgttacccaggctggggtacagtactgcaataatagcttactgcagccttgacctccaaggctctagtgatcctcccacctcagcct

SEQ ID NO: 383001 - DNA, 224 bp, Homo sapiens
tacctctctaaaactatctttaaagtttacatcttttttattcccattttatctgaatatgaagctttatgttcaaatatatgaaacttaaaaaaaatttaccagtttacatgctgttaaagtaaaatctttcttaatttttccagaaatgaacatgtcattatgatgtagtctttttctaaatacactgtttatgttcacactgaaacagaaatgcttatctg

SEQ ID NO: 383002 - DNA, 780 bp, Homo sapiens
tgagaccatcattcagcaattactcttactgcttgagaccgtcattatgactgaacgaagggacaaatgcagaaatgataaccaaaaaaaaaaaaagaaactgttttaaggaaaggcaacatgaggagaagagaggagagaaaaagaaaagagctccctgcttctagtgagcaaaggccactgcccgagcttctcagcccttcatatttattgggtaacaagagcaaggaggaggaggtaacaattggtcagctgcttaattgatcacaggttcatattgttacagacaggcttcaattttgcctaatcataagaaacatttatgcagcctccaacattacataatgataaaaggtctagtccaacaggaaaatattagaatcctaaatatatatgcacctaacactggagctcccaagtttacaaaaatagttgccactagacttaagaaatgagatagatggtaacacaataatagtgtgggacctcaatactccactgacagcactagacaggtcatcaagacaaaaagccagaaaagaaacaatggatttaaactataccctaggacaaattaacagatatttacagaacattctacccaacgactgcagaatgtacattctattcatcagcacatggaatattctccaagacagaccgtatgataggccgcaaaacaattctcaaatttaagaaaatcagaattatagcaagtactctctcagactgcagtggaataaaattggaaatcaactccaaaaggaacattcaaaacca

SEQ ID NO: 383003 - DNA, 392 bp, Homo sapiens
gatgtcttggtacaagtgtgagtgaggaggggaggtagtgaaggatgcaggagacttgtccatgatctctggcctgagctcctggaggagattgacaggaatttcatcctttgtttcccagtgtttttatcttgaagaatttgggaagttcatcacctagaaggtggctttgagctggatctagggttggaagtggaatctcagctcaggggagagggtgactgcacgctgcaggagtgcttatgtgtcagggtgtgtatatgtaagtgtatacatgtgtgtgaacatagacgtgtgtgtatgtgtataaaatctcaatgtgaggcctgttcttggaaagcagcactttcatgcagctgggccttgtttggggaatgagagatgacagtgtg

SEQ ID NO: 383004 - DNA, 427 bp, Homo sapiens
  misc_feature (7)..(7): n is a, c, g, or t
tgagatngagtctcactctgtggcccaggctgcatgaatattctagcacattgtgggggaaacctcctttcccctcgcttgcattttcacaagaagggaatgtttcctcaccactcctggcctcttgcctggtcccacatacattactcccagggagacgagggcgctcttcctggaaatggatagagcccgtcttcctttgtgaaccagccagcccacggcacctggtctcaaggttctcttgcagacctgagtttcacagggcaggccctgcccacggaggcctctggaggccaacgctgcttgtggctggacaatgagtcttgctccgaggttaagaatgaagcctaagaagctcatcactgccaggcatgcaaaccacaccttcttcacaatccagctgccattctgacctccaggtgcctgc

SEQ ID NO: 383005 - DNA, 358 bp, Homo sapiens
ctaatattattccttgttttatttatgggttatgaataagttcagagaagttaaataacttgcccaatccaggaagtattggtgccaggatttgaacctagtttgctcaaatccccaaatccagtgcttataactcctcacttggggttatagatacttgtagcaattggcctgggttgttattcacatgccacagcaaatgtctagcctaaattaatttggttcaagaaacttcctgggcctggtgtggtggctcaagccagtaaacccagcacttgggcatgctgaggcagaaggattgcttgagctaagagttcaagaccaacctgggcaacataatgagatgccccgctctctc

SEQ ID NO: 383006 - DNA, 2863 bp, Homo sapiens
aataaatttgaaacagttaatcaacaagtcttgaattctgaggatttggtggcctttaaggataatatctgaattcatttttcagtgatgtagaaaaatatgaaaacttacaaatgtccttaaaaggtggagggttagggggtggaagacaagcagggggttaggagataagtaagcaggttctgagaaaattgagaatagagttgctgacctgagagtcatggtgtttgggatacagtttgggctggatcagggaggtgtatcaataagggcaggccaaaaagaaggcagacatttggctcactagtggcaaagggatggattgggagaaggctgaaattgagtagctagagtagtatccagaagcaagagaatttaatagcttaattgagggctgtttatgtacccaggccctgtcctaggcttcctacacatgatctcatttaatccccataacatattggagatagaaatgataatacccactgtaggtggggaaaacagacctggagaagttaaaatttcacctgatgccacaaagctagaatgtggcagagccagagaccatgtttttctgaattctcttaattactaccttctgtactgcttttcttaattctgaaagtgaatctactgttgacattaaacttgtatttgcttattggtgtgtagtttgtaacctgacaccatcacaattttttgggagtagctttgtaggaatccaggtagttatttgaggcaggattactctcaatgatctcctcctgataaggacataagatactgccatgttctggagaacaccttattttggaaggtgcccccaaagtattagatagtggaggtgacagcaaaagcggcaaaatggggtttcatcgcagaatctacttactcagttcttttacacaaaaaagtttctcctatatttagaaaagtgtcaaaagaggccaggcacggtggctcacgcctgtaatcccagcactttggaaggtagaggcgggcagatcacctgaggtcaggagttcaagaccagcctggccaacatggtgaaaccccatctctactaaaaatacaaaaattagctgggcgtggtggcaggcgcctgtaatcccagctactcgggaggctgaggcaggagaaacacttgaacccgggaggcggaagttgcagtgagccgagatcacaccattgcactccagcctgggggacaagagcgaggaaaaaaaaagagaaaaaaaaaaaaacagaaaagtgtcaaaatagcactataaagagagctcagaaataaaagaaatgaaggaattcattaggaactcaaggaattaattacacatgccaaatttaaaaccacctctggatatacatcttaggacttttgtgaaatctgcattaatttctactacactaattttgaattcgaaataattcagacatgattgtgttttactttttcaaagcatttgattttttaaaaaatcgtgtgaaatgtaaattgtttatttttttgttaaaagtacatgtgtattacaaatatagatattaaaggaaattttaaattgtcaaatgagaaaatttcttattctggtggagtgtgaaagtcaacacatcttttgtgcatagagaaacacattaatttcctgcttttgtggtgttgcttctcttgcttttgtattattgtccattagctggtactgtggaattcatcagatttctgagaatcttaatgaccttatgaatctttctaaaataatgcgtaacaaacaagactttctttattctgacttacatctattgattcaacagtttttaggcattaagaatttatgatacattactgtgtaatgtcagcttcttttgtttacttggatgacttttttattagaatgacttttgttttaatttgtaatacaattttaatgccgtataatgtgcaggaacttcagaatagaattgctaccctgcttaaagtctgtagatgggaggctgggcacagtggctcaggcctgtaatcccagcactttgggaggctgaggtgggcggatcacgaggtcaggagacagagactattctggctaacacagtgaaactccgtctctgttaaaaatacaaaaaattagttggatgttgtggcactcacctgtaatcccaggtactcaggagactgaggcaggagagtcacttggtcccgggaggcggggtttgcagcgagccaagatcgcgccactgcactccagcctgggcgacagaacgagactccgtctaaaaaaaaataaataaaaaaggtaaaggtctgtagatgagatatacaaaaatcagctgtacactagcagtgaatcatccaaaaattaaagtaagacaattccatttacagtagcatcaaaaagaatacctaggaatagatttaacacaagaagtataagacttaatgaaaactagaaagcattgttgaaggaaattttaaaagatctaagtaaatggaagggcatccaatgtctgtagaccagaagacttaatattgttaagatggccatgctacccaaattgctctatagagtcaatgcaattcctatcaaaattttgattacagaaattgacatatggctcctaaaattcatatggaaatacagaggaccctgtataatgaaaacagtcttgaaaaagaaaaagttggaagcctcaaatttcctgatttcagtgcttaaaagaaagctgtggtaataagacagtgtggtgctagcctgagaacagatgtacagatcagtggaatagaattgagaatccagaaataaaactttagatttctggtcagctgatttttgacaggtatttactgctcagtaggcaggactagggtgatttctga

SEQ ID NO: 383007 - DNA, 949 bp, Homo sapiens
cctgtattcctcagctcttccctagtgcggacagggagtctatcctgcccacacactcactcaccatcagatacacctgtccctgcgagggggttgctctccctgctccacctcaaagcagggtttgggctacattgatgttatccctaaagacacccgccctatgtgtcccccattttttctgtgaggggggtcacgaccctgtctgtgccaccctccccccgcacgcacgcgcacacacacacacacacacacacacacacacacacactatatacacatactaggattaaacatttaagtaaaaatttgcactccagcctgggcgacagaacgagactccgtctaaaaaaaaataaataaaaaaggtaaaggtctgtagatgagatatacaaaaatcagctgtacactagcagtgaatcatccaaaaattaaagtaagacaattccatttacagtagcatcaaaaagaatacctaggaatagatttaacacaagaagtataagacttaatgaaaactagaaagcattgttgaaggaaattttaaaagatctaagtaaatggaagggcatccaatgtctgtagaccagaagacttaatattgttaagatggccatgctacccaaattgctctatagagtcaatgcaattcctatcaaaattttgattacagaaattgacatatggctcctaaaattcatatggaaatacagaggaccctgtataatgaaaacagtcttgaaaaagaaaaagttggaagcctcaaatttcctgatttcagtgcttaaaagaaagctgtggtaataagacagtgtggtgctagcctgagaacagatgtacagatcagtggaatagaattgagaatccagaaataaaactttagatttctggtcagctgatttttgacaggtatttactgctcagtaggcaggactagggtgatttctga

SEQ ID NO: 383008 - DNA, 453 bp, Homo sapiens
tgccttctaacatgattgtgaggcttcctcagctacgtggaaataaactcctggagggcagatgcatgcctgccatcttcatcgtttcattaccaccatccaacactatcgggggacctgccctgataatcagcatgtaacgaggctcaacacaactctgtatgggaacagtcaggttggagtctacaggtgtatccagcagctccagagagacagcgaccagcgagaaggggccatgatgatggtggtggttttgtcaaaatgaaaagggggatatgtagggaaaagaaagagagatcagactgttactgtgtctacatagaaagggaagccataagagactccattttgaaaaagacctgtactttaaacaattgcttgctgagatgttgtttatctgtagctttgccccagccactttgccgcaaccactttgacccaatctggagctca

SEQ ID NO: 383009 - DNA, 315 bp, Homo sapiens
atgaatataagagagctccacatttgtagactaatattaagtaattaaaatacaatttataattctcctaatagccaacatcatattaattaccgaaacaatattttgctttttaaacattaacgcttttctccacaaaagtattttaaggtttttctttattataaaatttgaggcaacatttgtgtcattcgaaaatgcaaagataaagacaaagcaatcccctattagtattcctgactctagtcaggaccacttagtgtatgcacattttatacagcaatatatttattacactattggtggtggtctttg

SEQ ID NO: 383010 - DNA, 1475 bp, Homo sapiens
  misc_feature (1092)..(1092): n is a, c, g, or t
gtcatcctgcgtgcgtcggagcagcagcaccggccccgggtagcagcacagctgctcggccacgttgaggttgaagtgctcgcgcacggtgcgcaccaccagccccttccaactgtggggcatgaccttcagcgccagcggcacaaggtcgtcgaaggtggcgtccagcaccagtgcacccagctccgggtaggtcatggtggcccaggtggccgtgaagccgccaacagaccagccgtagaccaccaggtgcgcgggcgggaagtgcaggcggtgcagtgcgtactcgaccaccacgtccatggcgttggcgtcgtgctgagggaagggcacgccagtgctgctgccgaagccggggtggttccagcccagcacggagtagccggcctcgagcggtgcagacagacagcccatctcgtagaagcccgcgttgccttcgcagcagatgacgaggcgcggcccgtgcacgtggctgcccgggtgctggcggcggtccatgaacatagtgtcgatctcgttgccgtcacaggccaccagcttggcgcgccggccgtggtagcgctccacgaggcgctcttggccctgctgcagcagcggcagcagcgcgcgcgtcatcagggacacggagccggggtacacgagccagcggcccagcgagtgggccagcgcgtagctagcgagctggccgggcagctcgcggagctgctgcaagaggcactgcgcctggctgcgcgccccacgtggaggccgccccagcgcatccccgcccaagcgtctcgtcccgcagcaaccacacgcccgccgcggctgccgcgcaggtcagcgcccggtggctgctgctccggcccacggcgcgcacgtcatcccagcggaaggccacgggccagccgcggaatgggtaggtgtagctggcggtcaggtagatcttgaacacgcgcaccagcgccttcacgaagcagatgacgcacatgagcggtggccctaacgcccagccgctgggccgggatcgccgcgagaggcacagggcagtcttaggggataccggctcccggacaagccctgatggcctttgtgacctggccttccagggcngagggaaggctgcatcctgttgctaggtgatgggtgcacaaagggttcccagagatgatgaacccaaggttctgcccgtcccccgccttcgccaagaccccaccagctaaacgctcccaggcccagctttcccacccatgatttgagcagctactgtctccctctttcttccttatttatttattaaattgagatggggtctcaaaaaaaaaaactagtatgttagatcaataagaaaaaaaaagagggggggggggtaaaaaaatttcccggggggcacaaggtattaggggaaaccaggttttgtggacaaaggggccccaaaagggggcggtttataaaagaagagcaggggggggtaaaaacgggggggcggggaactg

SEQ ID NO: 383011 - DNA, 1296 bp, Homo sapiens
  misc_feature (1092)..(1092): n is a, c, g, or t
gtcatcctgcgtgcgtcggagcagcagcaccggccccgggtagcagcacagctgctcggccacgttgaggttgaagtgctcgcgcacggtgcgcaccaccagccccttccaactgtggggcatgaccttcagcgccagcggcacaaggtcgtcgaaggtggcgtccagcaccagtgcacccagctccgggtaggtcatggtggcccaggtggccgtgaagccgccaacagaccagccgtagaccaccaggtgcgcgggcgggaagtgcaggcggtgcagtgcgtactcgaccaccacgtccatggcgttggcgtcgtgctgagggaagggcacgccagtgctgctgccgaagccggggtggttccagcccagcacggagtagccggcctcgagcggtgcagacagacagcccatctcgtagaagcccgcgttgccttcgcagcagatgacgaggcgcggcccgtgcacgtggctgcccgggtgctggcggcggtccatgaacatagtgtcgatctcgttgccgtcacaggccaccagcttggcgcgccggccgtggtagcgctccacgaggcgctcttggccctgctgcagcagcggcagcagcgcgcgcgtcatcagggacacggagccggggtacacgagccagcggcccagcgagtgggccagcgcgtagctagcgagctggccgggcagctcgcggagctgctgcaagaggcactgcgcctggctgcgcgccccacgtggaggccgccccagcgcatccccgcccaagcgtctcgtcccgcagcaaccacacgcccgccgcggctgccgcgcaggtcagcgcccggtggctgctgctccggcccacggcgcgcacgtcatcccagcggaaggccacgggccagccgcggaatgggtaggtgtagctggcggtcaggtagatcttgaacacgcgcaccagcgccttcacgaagcagatgacgcacatgagcggtggccctaacgcccagccgctgggccgggatcgccgcgagaggcacagggcagtcttaggggataccggctcccggacaagccctgatggcctttgtgacctggccttccagggcngagggaaggctgcatcctgttgctaggtgatgggtgcacaaagggttcccagagatgatgaacccaaggttctgcccgtcccccgccttcgccaagaccccaccagctaaacgctcccaggcccagctttcccacccatgatttgagcagctactgtctccctctttcttccttatttatttattaaattgagatggggtctca

SEQ ID NO: 383012 - DNA, 3573 bp, Homo sapiens
  misc_feature (2259)..(2259): n is a, c, g, or t
  misc_feature (2341)..(2341): n is a, c, g, or t
  misc_feature (2529)..(2529): n is a, c, g, or t
  misc_feature (2531)..(2531): n is a, c, g, or t
  misc_feature (3246)..(3246): n is a, c, g, or t
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacaggcagcacagtgcagacttctgctgcgtgagtgagttgcgggggccccagaagcacgaagcccagcccggcgtggcccactgtctcccgtgcatggccctctgcttacccggactcaggagaagggcgtgtttgcggcctggaggacaggcgtggagaggtttgcttgatttccataactcaacacttgcccacacaatctgcccatggaagtctggcctagaatgcttgttagggccagagcagcccctctgggaatgaggctctgtagcccccgcttttcttttggtttttgcttttagcaagattttttttttttaagtctatgagcactgaactcaagaaacaaacatgtgaagtggggctgctggggggaggtgagccccttgtcctcactgccntccctgcagccctgccttacccaaggcctagggactcactgattcgaggctggatgcattgacttccccagcacaccctccnctcacccctgcctccgtatctgacagatgactggtgggccaggggctggcggggggcttctacccagcgcagtgcccccacccttgtgccccacctgagggtagggcacagagtggccctggaattacctctggcccttaccagccccttgctgcccccaatccctagatgaggtccctggctggatngnagctccgttctgcccccacgtggggcctggccccaggcctcacccccagtgcagtgcccaggccaggcacaggtgcttctgacatggggcacacgtgtagtctccttacctgcacagcgatcataaccctgtgggcttacgagagagactcagccactctgtccagtgtgcagggaaagggctggaaggaagaaggccgaaaggaaaggccccagagagcacagtgctcagactcccgggtgacttctggtttctttttatatacttctgttaaatttcctgtaataacacatgctgcttttataatgttaaaaaaaccacgtagaatgtaggctgccccgtgtgttcacctcctaaaccaggacagttctgaggggcagctggaactgttgacacgcactctggcacgggaggcggacccaagagcacccaccccagaggggcaccacactcgcccgtcccgccctgtgtccccacctctgccctgaggtgaacacaggaggctttccacctgccagctgccagccaacctccccgagaggggcaggaaccgaccagcaggacagacccacccaggacagcggcaccaggtcaggcctcagcctttccgatcctctggagggctcaagccgaacggaaggagggaagaactgcagtcacctgggccggtggcgctcacatctgacgtggaggcctctgcttcacttggcccagntcccagccttgtcggcagtgaggacatggaccctcgctggcatccgtcctccgtctggcacaacgtgccgtgttctctctggttagggtttgggtgggacggagactgcgcccctgttcctggtccgcctaagtctctgccagtctgagtctcgtgggccttttctgcaggccctggggttgcggagcaggcagggggacgtcggtggctgggggacatcccgccacctgccaagtagctgcaatgggaagagatgcggttcccgtgacagccaggcctggatgttcaagtcatgtgagaccaccaaataccttgttgcactaagcc

SEQ ID NO: 383013 - DNA, 6172 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383014 - DNA, 5910 bp, Homo sapiens
ctttaatgatcttggactgaagctcataaaagttagctataaagttgaaaatatgtttattatatgtaaaatgccattataattaatgggtccttttattaataaccttttacaggttgtcacttacattctgtaaggattttgttttaattgttctcacatagacattgacttttaatataggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383015 - DNA, 5174 bp, Homo sapiens
ctgccagtggcatcattcacatacgggagaactgaggtctagtgaggtggccctctgcaaggtccctcagtaagcggagttggactcagaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383016 - DNA, 6620 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccgggggac

SEQ ID NO: 383017 - DNA, 6277 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctggggcgcacaggctgtggcttgcactccagccgctctagtctctcaggaatttgcttgttacttgtactgtgtaaataaagcttcctggttcaataccca

SEQ ID NO: 383018 - DNA, 3594 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383019 - DNA, 1117 bp, Homo sapiens
gacatctgttgagacctgacccctagtcattggttaccagtgtgtcaggcaatctggactttccagtgatgccactgagatggcacctgtcaaaagagcagtggttccatttctagattgtggatcttcagataaattctgccattttcattttcacttcctgaaagtcagggtcggcttgtgaaaagttgttaaacaacatgctaaatgtgaaatgtcaaccctcactctaaactttccctgttcagagcatcagatgaagacttcattgggttttatagtggctttcaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383020 - DNA, 3372 bp, Homo sapiens
gtcattttctctacatcaaaaataagacatcaccagtcctaaaggaatattataattcataaacaaaacattatattaaaattttatactaaagtataaaattatttctctctaggcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383021 - DNA, 5570 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttcgcacaggctgtggcttgcactccagccgctctagtctctcaggaatttgcttgttacttgtactgtgtaaataaagcttcctggttcaataccca

SEQ ID NO: 383022 - DNA, 561 bp, Homo sapiens
tttttgggtattgaaccaggaagctttatttacacagtacaagtaacaagcaaattcctgagagactagagcgtgctggagtgcaagccacagcctccaggacagcttccccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383023 - DNA, 3335 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383024 - DNA, 1451 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtcttactttaccagaactcttccctccagtgagttgcaagcgtgacatttgctgtgttttcagcacctgccaacttggaaagcagggtttgtgttcaggacttaggctcacaacccatactttgtggtgcacaatgctggcccagctggcatgctttcgtacctcaatggtgctagacagtcagttacaaagctgtgtggcttcacatgcgctgatctcaatagtcactcctcttcaagctgctttcaactcttattttgtatcaaaggagtgggattggtattattaaactcattgctgaggttatttttcagtgaaaataaattgttttatttagttgaaa

SEQ ID NO: 383025 - DNA, 3418 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383026 - DNA, 680 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaagtagagacagggtttcaccgtgttagccaggatggtcttgatctcctgacctcatgatccgtctgccttggcctccctaagtgttgggattacaggcgtgagccactgcgcccggccaatataaggtatgttttcatacagggaccttttctattttgtttactgtttttttttttttttttttttttaagatggatccagcctgggtgacagagcgagactccatctcaaaaaaa

SEQ ID NO: 383027 - DNA, 513 bp, Homo sapiens
ttccaaactgtttctcttccaagtcacttaatgtcttatttctctggctttattttcttcatggcactttatctgaagttacttatttagcttatttatcttttatctttttttgaggcagtgtctcgccctgtcgcctagacagtagtgcagtggtgcgatctctgctcactgcaacctctgcttcccagttcaagcaattctcctgcctcagcctcccaagtagctgggactacaggcacatgccaccacgcccggctaattttttgtatttttagtagagacagggtttcaccgtgttagccaggatggtcttgatctcctgacctcatgatccgtctgccttggcctccctaagtgttgggattacaggcgtgagccactgcgcccggccaatataaggtatgttttcatacagggaccttttctattttgtttactgtttttttttttttttttttttttaagatggatccagcctgggtgacagagcgagactccatctcaaaaaaa

SEQ ID NO: 383028 - DNA, 260 bp, Homo sapiens
tcagatattgtcctaaatgctttacatgtacagtataaacgtattctgcttgcccatgtatttccttcttttaactcaaggacgttaaaagattgaactatgtgtatttattaataacactagtgatgtttaaacctctgtcataaatagctctgtaatgtattagaaacatacatttaattcataatacagtttaattcaagagtcttgctttgcatttcattgtttacatagttgggatgctgtctatgagagagaac

SEQ ID NO: 383029 - DNA, 5736 bp, Homo sapiens
cacgaggacgccgcctgcctcctgcacgccgccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383030 - DNA, 6431 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383031 - DNA, 5178 bp, Homo sapiens
tgaggcccccagctggcgagcaccagaacctggagcctggcccctcctcagcagatcagacctcccagtccccagcacctgtggagggcacaggaccactcccttctagagactctgtgtctccaggtgaggccgagaactcatgtttccccagctccctgcatggctctgttacacaccaggctcaggacttcagctcggccccttctagcctgcggctcccgctctggttgtggagagtgggtagagcgggcgtcgtgtcgccctgtgtggggcagttacagcctgggcttcctccaagtcagatcccttctcaagggaagtatcgcggcgcgtcagttatgtttgcatagaggtccctgcttgaaaaacattgatttcaccaccattgtagggtgtttgggttactctcttcttttccatttaacggtatgttgccaaatttttacacacatcttagaatgttttcttaagataaaaatccaagtagtgaaattacctgatcaaggaattggatatattttccccaggttgcgcttcagaaaggctgtggacgaagtgttaggagcattcctgtttcaccgcagccccccagaactgggtctgcatcaaatttgtgtgctttgccgagttagtaggtgaatagtggaattgcgcgtgtctttatgagcacagagcgctcattggccggaggtgcatcttcatgagtacgttgctcatgggcccgtccttgcctggataggaggaacccgggacttgattggtcttgccacagcctggtggtctagttgctttgtggggtgtgcagtcctggggctgcgggaggggagtaacccttagtaacctgtgtgtctgcccctccacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383032 - DNA, 6323 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383033 - DNA, 6244 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaataccca

SEQ ID NO: 383034 - DNA, 3574 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383035 - DNA, 1471 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatacta

SEQ ID NO: 383036 - DNA, 3198 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagatcgggtctttgttttttttcacattaatattctttgatttcaaatataacatagataagtactcttagaattttgagttaagtatatgctattttaatgtgctaatcctacaaactaggctttctgtgtgactagactgagatgttgagtttgattcacaaaaagcttagaatggttctttgttgaaaagcttttcgagtcactatttggggcatgttagtgccatttgcaaaggtgaaggttttctttttttttttttttttaaccatagagcttttgataaggttaggaaaaggaagttgtcatctcttcttattactctaatcctgctggaagctagcttcttagggactaaaaccagaacaaatggaaggtccaaaaatgctaataagaaattagtattttcacataataccaaactgtaaaaaccaggccagcaagtgtcaccaggttcctgaaacaaaccataaatacattatttaacttagtattgttaaattgtataaatatgtgggtaactgtgacagaaattatgcacttataaaaagcagtaagttacatagtgaatgctgttttctgtggataagaagctggaattgtgatttcatttaatcgaaagacgcttactttgaggaaacttgtttgaaatgcaaacgcgatttctctgtggagccttcacggaattgctgcttttcactatgattattgctgcataacaggccacttctgtgtgtaggaagtgcgtgtgcaagtccaaagggaattgaggcctgaatgggtgggttatcccaattaacaaatacaaagttttcagtacattttgttttaagccaggtgcacaagttagagttgctttttgggactggcatttatgtatgtgagaatcaaacctgatatcactcttggcagcctgactaaagccatttaaaaataaaaa

SEQ ID NO: 383037 - DNA, 2359 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaaaatgtgagactttttcttggacgaattcagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagatagccccatgaggaaggcacatcgttatccattttacaggcggtggctgagtcttagaggaagcagtccagtgaaaccagaactcaagccacatatataatttaaaattcctagtagccagttattaagagaagaaagtgaaatgactttgaatagtatatttaacccagtatttccaaaatactatcatttccacatgtcatcgatgtaagtaaatcatgaatgcactattttatgtt

SEQ ID NO: 383038 - DNA, 216 bp, Homo sapiens
gagcttatccaggggtggcggaggcctcctgtgaggcaggggaatctcttgaacccgggaggcggaggttgcagtgagccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctg

SEQ ID NO: 383039 - DNA, 602 bp, Homo sapiens
gaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctg

SEQ ID NO: 383040 - DNA, 234 bp, Homo sapiens
catgagccaccatgcccagcctaaaatcatttttaagttgatcttatcttatagtttgttccatttccccgatgtcattttatgtgacacttgtcaaggcttcatgccttagagacttaattcacataaaaagttttggtttagcatttcagaccacttaaaggtcaatagcagccagtataatctcttcccttcttctactcttagaaacaggtatgagttttgtttacagtc

SEQ ID NO: 383041 - DNA, 426 bp, Homo sapiens
tcctgcaagtgcagatcatgatccctccagtagactgcacagcctcctcactaagttaacctcattgccccaagcagcataatgcattctgaacacgttactttggctggtaacaaaacagtcactcggctttcaagagtctcggctctgccagtgaaacaagctcagccgcttcatattccttcatattccttattcatacacgataaaaagacagtgctgaccaataaccacagcacagcgacagggaagggggaaaagaagagaaacctgtgcggtcttaataggcaccaggactgttctctgacctctccactggccactcagacacacactttccacacgaagcctccatgtgcaactgtacgacgtcagtgggaggcaggattgctggtatcagctaataaaaatcccagtatactgtag

SEQ ID NO: 383042 - DNA, 405 bp, Homo sapiens
taccaaaacgatgaggtcatgattatgtattttcattgacaaagcatgtgttgctacccatgtccaccactgagtgagcaacctgcccatacctgatgagctcttcccaaagcaaaccaacacagcccagatgcagccagctgcctcctactctttcctcatctcacgcaaatagataacattcatctctggctgttatagactgaattttgtccccctccaattcatatgttaaagcccctagtacttcagaatgtgagtgtatttggagatagggcctttaaagatgtgattacgttaaaatgaggttggcagggtgggctgcaattcaatctgtcttgtggcccttataaggagaggagatcaggacacaaacatgggtgcacaaggaggaaggaccgtgtg

SEQ ID NO: 383043 - DNA, 705 bp, Homo sapiens
acctcagatgtcgtacctcagatcggaggggagttggttattcatgaaagtgatgatgtttatccaatgtaccacctagagtgcccttggtgctctgctgtcctggagtgtaaccctgttgtggagaatgatacacaggacaaacttaccctgatgttgttaaatatatgttagatgaccagttgctttgatttctttgctcaataaacattggattacagctggtttgctgtgtggcatgcctacatggagggaacacactgagccaatgatttcatcatctgggtccctttggtttatatcagtttccaacatgacttgtttgtggggcttgtgggaggggcacatacatcggccccaggattctaacatctcctggtctctgaggttataattttcacttaacattgtcgagttggcattttggttttagtccaatggttcagttctttgaaactgactccagagatggctctgttcattaatagattgttttgttgaccctgtgaggattagtctgtggatcttggaaattcggcaggtgactacaattctagaaggcctcttgtgagatataaggtgttttccttaagtgacatggccctgcgttgcaaagctgagaagtaatatgaaggagcgttttgtaagtttgaatctctataatcaaaaaccagactaatgacacattcgcttttagaacttaaa

SEQ ID NO: 383044 - DNA, 3542 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggtgggttttttccttggctgaaggtatattattacaggtttgtgattgggttgagggtatggcagtgggaagtaatttcatgcaagttaattaagagagcaaccacaaggcagccttaggtttatgaaagtcgtagaattatcaaataccgcctggagttagaaggaagcagtttcttcctgtgcattggatgcagacactttaaatgttctctcctctaccgtatgttcttggttcaaagtgtaaacttttctctgtgaagctgttaatcatcaaagatgtgagttggtgaggtggaggcgaattccttttgatttcagaagaaaatatttgcgaatctggccatggaagccctctctgaccttttctccaaattagaggaattaactgaacatgtgctaaggcacatgaagcttctttgtgcggaattagagtgctcatgttgggagtgggcatcttgttaaactcacaggatagatcaactttggatggattttagacagtctatcacatgatagactttcagataatcatttatggtactcctgcatggtccggaatccccaggtttcttggagctttattgtcaaggaaaagtacaagcttagccacagcaatgtagagtttctgctgcttagctctttgcaacacagtcatgttggatgcttgagaaattggtgacctgcccttccaagtcttaaaaattgggggctgggtaggacttggaatgagggggttgtctgttacaaacttcatgtatcaagtaggttcagctttgtccttatttttcagtcaaaggaaagccatagacaccaatgtattccaggagggcttgactccatcctagattcttcccatagcagttcttgaatgcatggctgcacgtgcacctctccccatttttggggtccttcattggggtcaggatgaatgaagacatcaagctcactttgaagagcaagattctgatttggacaggttcatccttctgctcatcacttgttccccttcaattgataccctctcgttgttgggttctgagaatttgaaaccttgctctgaattgaacatgaaaaagggccgtgtagccaacatcagggacagcagtgcttttctcagtgtgagtcttttaaaacttgccttacaggtaagcatctgtctgtctttatcgatagataaggaggctcttttggctataaacctttatagttttcctgttatcactctgaggaattattgctttatgagagagtactctctcaagaggaaaagaaagtcctagtttctggtcatagctacgaattaaatttatattcacgtctgttcagctctctgaagttgttataggtattttggacaagaactaaagttagctaaagtttccacataaccatcaaagctgttatgaaaaagggaagaaggatggaccaggcagtaaggaggtcattaaatcgtccagagcttttcactaaaattggcagttccagtgtccagcctaaatggcttgaatgtatttttctctcttctggtctcagcgaacatgcttgtcagctagtagttataacagattgatgggtgaggcaaaatacgcgaaagttctttttggttacataaatactgcattaggactaagtgcagttgaagttacaatattattaattaatccctcccttttaaatttatatctttgtgaagcataggttagcaaatgcctttaaaaaatatatttcctttaggtcttaatgatctattcttttggatagtctatttcacctgaatggattgttgcttacaaattaaatatgtatcaggggctcccaatcctgaaagtcacctgaatttcctggatctctgctagaaatcaaccttttaagagataaaggagggtttatcctaaaagtactagttacttctgaaattcatgtcattactattgcttttggagatataaataacaacaaaacttttttttcttactactataaaacatcatggacttattggctctatagatacagcccaggtaagatttaacattttaaaaaattctattctgtcatctctaatatgtttcccaattgtttcaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgataggtaatggctcctgtacctgcaatggcatccagagattgtcttttctgatgtctgagacatggaggagaagtcactttatagtgctgtttcttatgcatgtggtgtcctatttacatgtttctaaaaacagttttcctctgggaggtgggatttcaaaaattcaaagctctttaatt

SEQ ID NO: 383045 - DNA, 5766 bp, Homo sapiens
  misc_feature (5766)..(5766): n is a, c, g, or t
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagataaaaaaaaaacaaaacaaaacaaaaaaaaaaaaaacaaaaagaaaaacaacacaacaaacaaaacaaaagaagagagaagagagaaacacacaacaacaaaaagaacaaagaagaacaacacacacacaacagaaaagaaaagagaaaaacgaagagagagagagggagcacaacagagacgacaacccacagcaaggagaacacgatcagaaaaaaaacaacaacagaagaagaagggaaagatagcaaagagcaacggaaatacgagcagaagacggaaaaaaagaagaagaacagcggcggagaagcagacaaacacaaacaaacacagaagaggagcagacaggacagcaaaaattagcagcaaatagaacccaaacaacagcgcgagagcaggagaagcaaagcacaccataacaagacggagaaagaaaagctgaaaagaaaaaacgaagagaaaaaacaaaaagaaaaaaaaacaacaaagaaaacaacggagatacaaagcagagagaggaagaggacacgaagaaaacatacacgaagacaagaagaggaaaacaaggaaaacaaaccatccgagcaaatcaaaaatgcgacagcccacgaagaaaaaaaaaagacaagaatcacagccaacagcacgagcaagacaatagaaaagacgcaaaaacataacagacaaggcaagaaaagacaagagatagacaggcgaggacaaaaaaaacgaagacagaaaaacaaaaaaaaaaaacagagaacaaacgaaaagagaaagagaagaaaggagaaggcacgataaacaagaaaacaacaaagaagaaaaagcgagaaaagacagagcagaagagagagcgaaaaaaaggagcgaggagaaatacgaggaaggaaggaggaggaaagaggagaaagaaagcaaagagaaacaggcagcggcagaggaaaacggaggcggaggaacacggagagagaaagacgaaaccagcgagaccagaagcaaacaacaagaaggagagagaagaacagagaagaaagagcacgacggaaagcagaagaggggaacaggcaaaaaaaaagacgagaaagagagagagaaagcaagaggaactgagagggaaaaggagaagcgaagagaggacacaagagagctaagaagaaaagaataaaagaggaaaagaaacgggaactgaacaaccgn

SEQ ID NO: 383046 - DNA, 5714 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggtgggttttttccttggctgaaggtatattattacaggtttgtgattgggttgagggtatggcagtgggaagtaatttcatgcaagttaattaagagagcaaccacaaggcagccttaggtttatgaaagtcgtagaattatcaaataccgcctggagttagaaggaagcagtttcttcctgtgcattggatgcagacactttaaatgttctctcctctaccgtatgttcttggttcaaagtgtaaacttttctctgtgaagctgttaatcatcaaagatgtgagttggtgaggtggaggcgaattccttttgatttcagaagaaaatatttgcgaatctggccatggaagccctctctgaccttttctccaaattagaggaattaactgaacatgtgctaaggcacatgaagcttctttgtgcggaattagagtgctcatgttgggagtgggcatcttgttaaactcacaggatagatcaactttggatggattttagacagtctatcacatgatagactttcagataatcatttatggtactcctgcatggtccggaatccccaggtttcttggagctttattgtcaaggaaaagtacaagcttagccacagcaatgtagagtttctgctgcttagctctttgcaacacagtcatgttggatgcttgagaaattggtgacctgcccttccaagtcttaaaaattgggggctgggtaggacttggaatgagggggttgtctgttacaaacttcatgtatcaagtaggttcagctttgtccttatttttcagtcaaaggaaagccatagacaccaatgtattccaggagggcttgactccatcctagattcttcccatagcagttcttgaatgcatggctgcacgtgcacctctccccatttttggggtccttcattggggtcaggatgaatgaagacatcaagctcactttgaagagcaagattctgatttggacaggttcatccttctgctcatcacttgttccccttcaattgataccctctcgttgttgggttctgagaatttgaaaccttgctctgaattgaacatgaaaaagggccgtgtagccaacatcagggacagcagtgcttttctcagtgtgagtcttttaaaacttgccttacaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383047 - DNA, 3139 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383048 - DNA, 1286 bp, Homo sapiens
  misc_feature (9)..(9): n is a, c, g, or t
  misc_feature (24)..(25): n is a, c, g, or t
aagcagtgntatcaacgcagagtnnccattacggccggtctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383049 - DNA, 1183 bp, Homo sapiens
ttttttttaaaagcaggctggtaccggtcggatcgggatatgtcgacagcgtcgactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383050 - DNA, 1765 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtgaaaagagaaagcgaccaaggaactcccttccctgcatgtgctggtaaccatgagcctgggaggctctactcagactttcttttgctggcataacagcaagaattcaagtgagagtttatgaaatgagtagacagaagagtattcctggtgagaaaaatttactgttcctt

SEQ ID NO: 383051 - DNA, 794 bp, Homo sapiens
acctctagcttatctgtcaggtataggtggttatttgctttatgaaattattcgtaatagttcacttataagaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383052 - DNA, 527 bp, Homo sapiens
ctataaaaaaggtagagacaatagcagaatttctcttcccaagggctgtatattttgcagctccccagatgccattttagcatgcactttcacaaatgagtttctaactcagaaaagtagttacattcttccttagaaggtttcttcggcataagcatttattgtaacaaatttttaaaatgcaataagctgtatttaagtaatgggatgccagttctgactaccccaagaaaaacaattgtggatatgataaatggtgagaaaggagaagataaattttagtctagcatgagtagttttgctttatcaacaaaaagcacgtgaaaggcaagtgcgcttgctctttttctcttctgaaagtattcagctgatgaaaatcctgattgtagacccttctcttctgctttagtttcagttgaagaaactccaggttggcccacaactctcttagtagtcatgggaacactggtggctttggttggtctttttgtgctgttggcttttcttcaatatagaagacttcgaaa

SEQ ID NO: 383053 - DNA, 664 bp, Homo sapiens
catctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagattattgtttgtcttttgaggattattgttttttaagtagtgtgcatcaattcccatcttttgggcactcagcatgtatattgaaatatatatacatgtaaaatatataataacaacctcagtctgaaaaataatctcttaaactgatatgctattttctggtgagtttccaaacaattgctattttctgaatctgtttgaacaggtaggaaaaggagagccagcctttcctcaggtgaagttacttttgatattccccacagtttagtgactaatcctggggtggaagcaggtggctgcttcaagtgactgaccagggaagagaggtcctgcagtagctaacttggtgatctcccagataagccttcaagatgggtcaatttgttggagactctaaggttgaagctcttcctatttctatagtgccttacttatcctgagtattttataaatattctttgaatgaataagtgaatgaataaactaatttcaaa

SEQ ID NO: 383054 - DNA, 4567 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383055 - DNA, 4043 bp, Homo sapiens
gctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagtcaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383056 - DNA, 4378 bp, Homo sapiens
aggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383057 - DNA, 1498 bp, Homo sapiens
  misc_feature (9)..(9): n is a, c, g, or t
  misc_feature (24)..(25): n is a, c, g, or t
aagcagtgntatcaacgcagagtnnccattacggccggtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaataggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagat

SEQ ID NO: 383058 - DNA, 405 bp, Homo sapiens
cttgctggtgtttgtgacccctacagtatagtcagggtgccatataatcaggacaggaaatattaggatttcagaaggaatagagcttaccttggagagcagagtatagtggaaagaatagggctttagagccgggccaatctacattcaaatgctagcctgccctcctgctagcttttgccttagagaaatattttccctccagctccctttgcttatgataaaatggataatatcaccttccttgcctcccttacaaggttgtagtgaggattagcaataacggatatagagtgcctgatgtgcctggcacctgagcacatgccatcgtagatcttgtggaagaagtctggcaggatgctttggtttaagtacctggaaactgttataaaaagaagcatggaa

SEQ ID NO: 383059 - DNA, 479 bp, Homo sapiens
cttcatctaacaattctataaagtatgtgccatttattaacccattgtactgatgaggaaaagtccatagaagttaacttgcccaaggtcaccaattgtaaatggtgaacacagacaggtaaactcaagagctatgctcttgaccactgcttgcacagtgtggtagacagaaaaaatggcttctcaaaaacatcctaggctggacacagtggctcatgcctgtaatcccaggactttgggaggccgaggtgggcaaatcacttgagtttaggagttcaagaccagcctgggcaatatggcaaaaccctgtctctactaaaaatataaaaattagccaggtgtggtagcacatgcctgtagtcacagctacgcaggaggctgaggtgggaggatcacctgaacccaggaggcaaaggctgcattgagccatgatcatgccactatactccagcctgggcgacagaatgaaaccctgtctc

SEQ ID NO: 383060 - DNA, 429 bp, Homo sapiens
aaaatgatacgtaaaatatttaatgacgaggaaaatgatacactgcaagatgaaactgattattaaactataaataatgatgattacatttttaaaaactttataattctatatacataaaatagggaaagatataaagcagaatatctctgccattaaaattatgtttacagaaaaaataagaacacaagagaacaacttgtaatgtttaatgaaaaatggtagaaatatgggatctaattaaactaaagagcttctgcacaacaaaagaaactaccatcagagtgaacaggcaacctacagaatgggagaaaatttttgcaatctactcatctgacaaagggctaatatccagaatctacaatgaactcaaacaaatatacaagaaaaaaacaaagaaccccatcaaaaagtggacaaaggatatga

SEQ ID NO: 383061 - DNA, 635 bp, Homo sapiens
caatcttgctcttcctatttcgggatacctgcttcattgatgggtggtctctaggacttcagagggaaaggctgaggatagacttagaccttggggagggtctgagccaatcagtgacttacattcactcagttgccatctaataggtggtcctcccttagaaaattggcggctttctggcagtgtttggccctctctttggggaagtgtggattactagagtgcaggcgacagagatggcctgggatggacagcttagtcatcatgaaagaatgtgtaaggcatcgggtggcccctgaattctgtctgacacatttgttttcccagaaatagaattgcattggagagttggggcccagttattagaaatatggggatggggtgcttgtacttgttgcagtcttgtggcttctcataatcttttctctcctaatccttcctcttgcctacatgttgcaattctgatgactttttgcagcgcacagttcatttttcttcagcatcccgctcagcacactggcttcctttatgtcttaatgggcatccgtctttccttttcatgtcattgattctcactcgtggcccccatcttccctgtatgcttattgaataggtgcttaaaaaacaaaaaaaaa

SEQ ID NO: 383062 - DNA, 618 bp, Homo sapiens
tgatctagacgatccccttcgacggtgtctgcttaaaagctttgatagccactgcctatataataaagcccctaagatccccttcttgagtaaagtttattggatgtaaatcacacacacacacacacacacacacacagagtctctctctctctgtctctgtctctccctctctcacacacacactctccattcccatcatccatgtctgctccatcctacagggctgagttttgctatggaacagctggctgatctgaagaactaagaggctgtatgtgtgaccatggggtcagatgctgcagccctgactctggtcatggatatgagtctaacaggagcctcctaagcccagtgagaggggttcctgttagtctggcaaggaaagcagcaagagaggagtgtcaggcaggtatctggacctgacaccacgtgggcacctgcttatatgtggaattcccctccagatcatctctgcttcctaaatgtctccacagctttcttggccatacaaggcaattcccctcattccagaaaagcctagtcttcaggaatatgcaatggaatgaaaagatataactcactgcaaagaactcagctggtgcttcttgccctgcg

SEQ ID NO: 383063 - DNA, 335 bp, Homo sapiens
tctttttttttttagacttggggagatcacttatagagagagagattgagagagacaaagtaacaagagttttaagaactgagctcccagaaaattcaatcattaggatactgtggaagaaaaaacagtaaaagagactaagaaggaacaaacagaagataaagggaaaccagacggtctgaaaaaacaaatgtttcaagcaggaaagaatgatcaactgtgtcaaatgctgttgatgaatctcagtgttgtcaaggatttaagatttaaccttagttttagctaagtcatggtgatgggtgaacttgaaaagagcagtctcagtgaaattggga

SEQ ID NO: 383064 - DNA, 1170 bp, Homo sapiens
tggggtgcacaggggtgctacaaggccagcttcccccacatctggcgtggctgatgagagcaactttgctgctgcttttggggcagaatccatccttgtatagcctcgggcacatggttagaatgctgggagtatgatgcctggaaacaatactataaagaaagcaggactcagttctctcatctagaaccggtggcccgtcgttttgccgttacagataccagcagtgtttgtgacaaaccctaatggaacagaagctcccggtgggtgtgtgaatggccacgtgtctggccgtggcttgcttttccagaaccaacttggtggttagcagtcgttgccagctgcctcgtgtgagcacctactgtgtgccgggcaagccgctgggaatttcacgtctgttcattttctcttcactgtggcgtcagatcacggagtaggtgtaaatagttgcctttaggatgtgaagctggggctcggagaggagaggccagcttcttgaagactgaagagcctagaagattctgtgcaacctgtgtgtggctcaagagcctgtgcttctcccaggggtgacagctcccccactagatgccgtgtccttggagacttgaactccccctgtgctctgaacacaccagctgccgtggtagccatcagacgtccctactggagccattttggcccaagagaagtggctgagatggggatatggccctggtttgtgcaaactcagggaaactcggggatgtgacctcctgcagctttgccgtgtgttttgacctctcccaactgcttgggtttctttttttttggagacagagtctcaccctgtcgcccaggctggaatgtggtggcgtgatcttggctcactgatactgccgcctcccgggttcaagcaattctcctgccttggcgtcctgagtagttgggattacagacgtgcgccaccactcctggctaatttttatatttttagtagagatggggtttcactgtgttggccacgctggtctcggaactcccgacctcaggtgatacgcccgccgtggcctcccaaagtgctgggattacaggcatgaaccactttacccggcctgcttggggttcctttgaggccttggacatccgacagcattactgagggccggatttcaatcctttccacagcatctt

SEQ ID NO: 383065 - DNA, 306 bp, Homo sapiens
ttcttgtgactttttaatttcaaagctaatgagcaagattttgtgttttccccgtcctcaaaacaacaggaaagcattttggaaggccaagtgtttttcttacatttcaataaatcaattttagctgaattatcatttttaaagcactggcgggcatggtggcacatgcctgtaatctcagcaactagggaggctggggagggcaggtagcttgagcccaggaattccaggttacagtgagataggatagcgccaatgcactctaggccagcagcaacagaacaagaccatatctctatttaaaac

SEQ ID NO: 383066 - DNA, 6159 bp, Homo sapiens
  misc_feature (2)..(2): n is a, c, g, or t
  misc_feature (9)..(10): n is a, c, g, or t
  misc_feature (14)..(15): n is a, c, g, or t
  misc_feature (20)..(20): n is a, c, g, or t
  misc_feature (24)..(24): n is a, c, g, or t
anggtgggnncacnncttgnccanaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacagtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcccggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaggggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtg

SEQ ID NO: 383067 - DNA, 6014 bp, Homo sapiens
  misc_feature (2)..(2): n is a, c, g, or t
  misc_feature (9)..(10): n is a, c, g, or t
  misc_feature (14)..(15): n is a, c, g, or t
  misc_feature (20)..(20): n is a, c, g, or t
  misc_feature (24)..(24): n is a, c, g, or t
anggtgggnncacnncttgnccanaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacagtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcccggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaggggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtg

SEQ ID NO: 383068 - DNA, 5327 bp, Homo sapiens
  misc_feature (2)..(2): n is a, c, g, or t
  misc_feature (9)..(10): n is a, c, g, or t
  misc_feature (14)..(15): n is a, c, g, or t
  misc_feature (20)..(20): n is a, c, g, or t
  misc_feature (24)..(24): n is a, c, g, or t
anggtgggnncacnncttgnccanaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacagtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcccggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcaggtgcgccccgccctgctgggctgagaccccacagctcattatctcccttcttcctgggtccctccacttggggcacttgcctctgtcctccgcctgagaaggcgcttgtgctactacaggtgaagtcacctggccctgttgaggagtgggaaactgggttggggggctcctagagctggactcctagctaagtaacccccaggaggcccccagagaacggctgttagtgctagctgaggaccagcttgggttgaggattgctcaggaagccggaagcctgagcacgtggctcacgtgggtcacacaccgaatcctccacacgaccccactgatgggtgccccataactaagaagaccctggctgcctctcgaagccctgtctctgccatcatggctgtctcagtggctgctataatcgtaccagcctttcctgtcaagcctgaaattgaatcacaagaacttccaaagccatcaggagatgagtgacagataagtcagtcggggggctgctccccactgctccggtttcacccatcctgacacccgcttgctgggctctgcttactctcaggagcttgcagccactgccagctccctgcgttgctaggtttccaagttaatcagaggtgccagagtcagcaagagcaggaggcctgttctctgtatcccatggatccgcggttaggtgattaaaattgagaaggaaaac

SEQ ID NO: 383069 - DNA, 5120 bp, Homo sapiens
ctagtcgacgtctaggtggaaagcgcgtgcacattgcccggagggaccgtgggaactccctgcagctgtccactcggtgactttactgctgtagacccccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacagtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcccggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaggggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtg

SEQ ID NO: 383070 - DNA, 1379 bp, Homo sapiens
ggggaatcacttgagcctaggagtgtagaccagcctcggtaacaccgtgagaccatctctacaaaaaaaaaaaaaaaataagaagaaaaattagttgggtgtggtgacgagtacacataggcccagccactcgggaagctgaggtgggaggatcacttgagcctggaaagtcgaggccccagtgagccgagattgtaccactgtactccagcctgggcaacagagccagaccctgtctcaaaaaacaaacaacttgatttttaataactctgatagtccatcttatatatcataatatacagttaacgactgagtaagtatgtaggttttcaatctgtgttcgttataagcacacctacataactttgtgttttctaatatctttagggcagatcaaaggaaggaaagtgggggaggagagagggaaaatagtgtaaatgaagaaactgagcagtgtattgtgcagaattggtgtctgacgttaaagaagaaaaaacaagggtaccttgatgccccagggtggtctttgtaaaataatccaaagactataaagttcagtttaaaaaaaccaaacacatagctataataaattaggaccatctgttgttctacccaggcctgcgtactcagtctccagcctgttgcttatttaagaatgcctttacaatggtgaaggagtgctgccagggtgtctggagggagtcaggggaggcgtgtggggcaaggaggaaggcagcagcttggggagccagcatgggctgctgtgctgttcccacactggttaccctttggggccagaatcaatgtggccactgtggccttgagattcttgccacctgtggcctttgacagcccatccatgggtatgggatgggagttggggttggcctgcttaaaaaaaaaaaaaaaaaaacaaaacaagtgaaatcaattttagaatgttttgtaaaaaagggaatttcacttgaacatttaataacctatgactcttttacatatacagcctcccttggtgttcaaggggaattggttccaggacctcccgctacaccaaaatctgtagatgttaaagtcctttatatatataaaagggtgtagtatttgcatataagctatgcgcatcctcctgtatactttaaatcatctctagttacttataatagctaatacagtgtgaatgctatgtaaatagttgttatactgtcttgtttctttatttgtattcttatttttcctgaaatttttgatctatggttggtagaatccatggaaatggagggcgggctatacctgtctctgcatgagcctagtattaatctgttttgcaaagtctgtgaaccaatctaatgtaggagctttgcctggggatcctctagtgg

SEQ ID NO: 383071 - DNA, 471 bp, Homo sapiens
cagcaaacaccttggttgcaaccccatgaaagaccttggtccagaagttcccagtaagccacacctggcttcctgacccaaaataacagatgtttgtgttttcagctgctaagctttaagataatttgtttatgtagaaataaataagggacaaagacccctggagatctttgaggaatcccactttgtatatgtagaaactgagggccaaaaggagaacaatcacttacacaaagtctggagacgactcacatggtcactaaatccttttgctctttctcatttttactctttaactggctcctcactttgtagatggttggcactgggctttgcagcaacccattgttatgtttctcttgaggcttctaaagcctcattaattcagtcatcaaatattttttgggtgtccactatgtgccaggttaatgctaggttcaagaaatacagtaatatacaaaaacaatccta

SEQ ID NO: 383072 - DNA, 883 bp, Homo sapiens
attctttttttcccttagattttaatccaagtgattatgaatgtcaaggattaaaatttgggggggttatttgggattccctggattcagatttctgagattatgcttcctttcctttaaggaaaggttttcattttcattataatacaaaaagcaaactgcttattacttttccaccgtacaaaatgcagttgacctacctcaacgctttgtgcattcacctgaacagaagcattttggataactaacgcgtgcttaagcctctgaggacctcattcactaagaggacgaggcggcgcaagtccagctgtggtcagtctcagtgttcccttcagggtccgccggctcacgctgggagaatgagagggacttcagatgctgcttcagttcccagctgtggctgaagctactgggttcacccagctcacctacagtttacagagaaataaagcaaaactcagatgcattcagacagaaccccacctcgagggcaagcctcagctctgatgaagaccagctgacaggcccctggctcccctaagccatggcagaggagatcattcattcacatgtcagagacaaagccccaggagtctggattgtgaagtaaacgctgagcccgaccacaaccactgtgaatactgggcaactggggcgtctcagaggattcaggtaattgaacaaatagacttcatacggaatctcaactctcctctggtcagcaatatcagatgtacttctgtgtgaataataaaccagactgcctggatgcgggagcacacgcctggaatcctggcactttgggaggctgagatgggaggatcactccagcctaggagtttgagacctgcctgggcaacatagtgagatcccatctttatta

SEQ ID NO: 383073 - DNA, 92 bp, Homo sapiens
actgcaggaacagccagcaccagagatatctcctgcaaggcctcctaggtgggttcttggaagaaaggaatgccaatgaatatgattgcaag

SEQ ID NO: 383074 - DNA, 329 bp, Homo sapiens
tccagggctaaaaagttaaacaacaacaataaaaaggctgaaactagagtagtatactagcagtgtgtttcctttgggggcatttggctgatagcagaagtagagcacaatcagggacaggtgacaggctgctctctacccaaagcagagagatagaattcatatccctgtaacctcccaggcacatgcttcaatgtcaatgggtgccattccatggtagttgaggtaaatggtacctgtgtttcagggggtgatgttttcatagaataaagtttaagtatttccacttgaaattgtacaactcatggtattggagaagcaccttgccc

SEQ ID NO: 383075 - DNA, 411 bp, Homo sapiens
ggcatctcatccagcctcataaagctatgaggatggctataacatgacatcacgggtaagaagacagccctgttccctacatatttctcctgctttgctcactgattactgaaactttttttttttttttttttttgacagaagcaaaggctttcactttctggagtgaaaagagaaagggaacatggacatgctccttgaatggttaatcaccctgccccccactgatgcctgtgtgacccaagctttcctccttccttgctagtcacttgccccaagacttctacacatcaactccccgctctggagtctcctctgttgtcataaaccattgggttgtccagaatcttggctctcaaaacatggtccatgaaccagcagtattagcatcacctatgaatttgtgtccaa

SEQ ID NO: 383076 - DNA, 728 bp, Homo sapiens
aatttttttgttttttattgtagacatcttttacagttttgttaattcctaggcattttattttatgtgtagcccttgtaaatgatttttttcagattgttcactattggcatttagaactgttactgattttttgtatgtcaattttgtatcctgcaacctcactaaattgttttataacttcaaatgattttttggtgaagtacttaggcttttctaaatataagattatattataaatttgacatctccctttccagtttacatgtcctttgtttctttttcttttttgaagggatagcagagaacttcttaaacctagagaaagacataaatatccaagtacaagaagaatatagaacaccaaacagatttaacccaaataagactaaatcaagacatttaataatcaaactccccaagaacaaggataaagaaaagatggccaggtgcggtgactcacgcctataatcccagcactttgggaagctgaggcgggtggatcacctgaggtcaggagtttgagaccagcctcaacatggagaaaccccgtctcttctaaaaatacaaaattagccgggtgtggtggtgcatgcctgtaatcccagctacttgggaggctgaggcaggagaattgcttgaacctgggaggcggaggttgcggtgagctgagattgcgccattgcactccagcctgggcaacaagagcgaaactccatctcaaaaaa

SEQ ID NO: 383077 - DNA, 3484 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383078 - DNA, 429 bp, Homo sapiens
caggaccatcagtaaagacagggccaggtgcagtggctcctgcctgtaaccccagtgctgtgggaggccaagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtgggaggatcacttgagcctgggaggtggaggttgcagcgaaccaggatcatgctactgtactcagcctgggtgacatagccagactgtgtctcaaa

SEQ ID NO: 383079 - DNA, 309 bp, Homo sapiens
ctagaggatcccgcattgcttctgtgtttcaccaaatatggcaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagaagtcctgaaggaaatccagagcacgggtaccgagct

SEQ ID NO: 383080 - DNA, 3562 bp, Homo sapiens
gactgtgaagctggcctggccccggggtggcagcctactggactcggagagagaggccctgctccacctgtttgggccgggcctaatcgatacctgagtgccaggacagacccctgcagctccttctgtttctccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383081 - DNA, 3843 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggtgaggcaccgcccaggccagctggggtgggcccgaggctctgccagagggctcaggggagcgctgagagtggaggtccctgaggccatgactcccctgtctttgcctgtgcaggagcggcaactggcgttcacatcgagccgccgtggggtgcagcctcagcaatggcggaggtgggggctctgggcttgagtgcagctgccaaccgtgctgggaagggctgggaggaagagccccggccccactcccctgggtcccacggggctgacacgtgccctgatgaccaggaaagcaccatgtctgggctcagcgtgggcggctggggcaccccgtcctgcccagggtgatcttgagctgtccctctgtgtccttcagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383082 - DNA, 4990 bp, Homo sapiens
  misc_feature (4337)..(4337): n is a, c, g, or t
  misc_feature (4718)..(4718): n is a, c, g, or t
  misc_feature (4878)..(4878): n is a, c, g, or t
  misc_feature (4973)..(4973): n is a, c, g, or t
  misc_feature (4985)..(4985): n is a, c, g, or t
  misc_feature (4990)..(4990): n is a, c, g, or t
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggccctgggccctgggcttccacatcctgacctcagtaaggagagagagagccaggccgaggagggcccaggcggggcgccctgacccggcctctaccttccagagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttgaaaaaaaaaaaaaaaaaaaaaaaaaaaaaaaaaaaaaaaaaaaaaaaaaaaagaaagaggagcaaaaattaaaacaagaagagaccaagaataacacagataaccaaatagatcgaaatgcaacagggccccccaagatggatacataacaatacaactaccggactaggaccgcagcatataaacaacctactaactcaatgagcaagacagacgtaaacctcagcaacactctcttaataacagcagacaccagcaacttctggggcgatcaggaaccactaatagtgaggccacacgatctactcgcacaaagccgaaatgtaaattaagcagcccccatccatagcggcacagagagaataacaagcccatacgcgaagcgtgaggaataaacggcgactatcagataaacacaatcacgagaaccacaacgatctacagtgacggacgtctaggacagacgagacatgacccaacactacaagggtcaaggaaagtgcacatacgcgtgaaccagcatcatcatacatcatgcacggcagcagcacgcgaacaaacacataaggcaacgcagtccaaccgaacagagcatcaacgacagacaacctcacactccagcaccatgaacaccagaacaacatacaacagccagccgactacagcacatgaatacaacaccaggagacaacaagagtagagtagaagnaacgtgaacgagacgacaatagaactgacgtgaagaagcaacgacaggacagacgaaggagaaagagaagacagaaggggacggacgtaagagcgaagatacggaaacgatgagagatgaaggaggaacgaagagaggaatacgctcacatgagagatcaagcagggacaggacgcaggagtcgataagcaagcgagacgaagatcgactgaagagacgaatgaagcacgagcggaagagtacagaagacacgagtacatacaagcaaacgaacagacgaacgacagaggacgaagcagcgagtgcgcgagacagcaccaaagagtgagcagacgacgaagaaatcagcatcgtagagacaggaccgaatcagaaaataanaaacgtgcgtgcacaggtgaacacgctgtagctgagaagcaagaaacgcacgtgagacaagaacaagaatcagacgcagtgaacgacgcatagttcaagaacgaggaccagaacgtgcatgagagccaaccagacgctagaacacagaagcagatgcacncaggaacaagacgaagacgagagcgaacgaagaagagcaatgcacgtgcgaccgagcacagccatagagcaagcagggcagcagaagcgcacagncaaagtgaagcngaagn

SEQ ID NO: 383083 - DNA, 3524 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcttaacgcgaagttttataccttccggtgtgggttttgtgg

SEQ ID NO: 383084 - DNA, 3252 bp, Homo sapiens
  misc_feature (3016)..(3016): n is a, c, g, or t
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcnggactcacagtgatggcaagagaagcagccgggctgggatgagcgcgcccggtcaggatgagagagtccgaaggaagtcccaagccctcggggggacccgggagcgcaccggcggtccctccagcccccggggggcacctacaaggggccaaacgaggcctacgcacacgggagaagaccaatcagaggcgccggggcgcgcccccacagaggcaggcccccagcaggagcgcaca

SEQ ID NO: 383085 - DNA, 2959 bp, Homo sapiens
  misc_feature (2878)..(2878): n is a, c, g, or t
  misc_feature (2903)..(2903): n is a, c, g, or t
  misc_feature (2918)..(2918): n is a, c, g, or t
  misc_feature (2939)..(2939): n is a, c, g, or t
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaagaggctttcttaccttgattnttaaccctttggagttttaaggcgnttttttttttttccnaaccaagttggcttggttggnagcccccgggttttttttgg

SEQ ID NO: 383086 - DNA, 1526 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtgggaggatcacttgagcctgggaggtggaggttgcagcgaaccaggatcatgctactgtactcagcctgggtgacatagccagactgtgtctcaaa

SEQ ID NO: 383087 - DNA, 1315 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacgtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtgggaggatcacttgagcctgggaggtggaggttgcagcgaaccaggatcatgctactgtactcagcctgggtgacatagccagactgtgtctcaaa

SEQ ID NO: 383088 - DNA, 2972 bp, Homo sapiens
cgacagagtgtgaaaccgtctcgagaaaagaaaaaaaaaaaaaaagacaaatggtttaatcatccagcgcacatttattgagcactagctgggtccaggcctgagtgaggtgatgtgattgtgtgcagtaaagaaaatgccacccctagcaactggtgtgctgaagaccacgcgtgctgctgcctgtggggagaggcttgacaggtgcatctgagcagggagagcaggccccatggaggagaaaccagggaagagggttggcaggcacagctgcatgcctctggggtgcctatcctggttgggaccctgccttccagccaggtgtatccccccaggagccctgtgccagggagctctcagcagccttgcatgcagagccagggctactgcccacacctgctgccctcctggagatggaaaggctttgctcaagcagccaagaacagggctttctggatctgcagatgccctggctccaaccctggagcttctgattccacagagctgggctgcttcctcctggccccggcccctgacccttgccctgtaccccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggccctgggccctgggcttccacatcctgacctcagtaaggagagagagagccaggccgaggagggcccaggcggggcgccctgacccggcctctaccttccagagaagcagcccggcctggtgatggagcgcgctctgctcagtgatgagagagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383089 - DNA, 3527 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383090 - DNA, 3629 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggccctgggccctgggcttccacatcctgacctcagtaaggagagagagagccaggccgaggagggcccaggcggggcgccctgacccggcctctaccttccagagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383091 - DNA, 3454 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383092 - DNA, 1572 bp, Homo sapiens
gaacaaccaggaacctcgaccagcataccagcagcggcggcaggtctttgttgtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383093 - DNA, 1403 bp, Homo sapiens
cctgctgtatcacagcaagggctgagctgacctgggattggggtcttctatgttggggcctgtgtggttgtcagagagccttccagcctctcccaggagggaaaacctgggagtaaaccctggttgcccagctccacccgactcccacgctaagggtcagacacccaaacatggcttctcggcaggctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttga

SEQ ID NO: 383094 - DNA, 1360 bp, Homo sapiens
gccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcacatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctaggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtgggaggatcacttgagcctgggaggtggaggttgcagcgaaccaggatcatgctactgtactcagcctgggtgacatagccagactgtgtctcaaa

SEQ ID NO: 383095 - DNA, 418 bp, Homo sapiens
caactggagaacatctggtggcagcgggacggccgcctgctcgtcagctgtcactctgacggcagctactgccagtggcccgtgtccagcgaagcccagcaaccagagcccctccgcagcctcgtgccttacgcagtgtttcacccgccgggcagggcccacccccagtgcctcctggattcaggtgcaggttgctcaattctgaagcaaactccagggccagagagggtaaaggctttgtccaaagccacacagcagggttcgcctcacccagtttcttggggaacttctcggagcaagattcccaagcacaggtctaccatgtggatgtggcatgagctagagggatctgtgcctgtggggactgacacttgtctgagagtttgaggatccgttcaagccgattcctttcctttca

SEQ ID NO: 383096 - DNA, 577 bp, Homo sapiens
gcagaaaacttgggttgattctgtaaagggaattctccttccctccaattctcataatgttcattaaatgaaaattcctagaagtaaggatctgagtccttctgggccagggatccagagtacagacgatgtgcacatctgcccaggcccagccactccacgtcatgactctgggaactccaaccactgctcctcaacaggcagcactgtcgaggtcacctttcaaagaattgctctttctgacctggtgctcctcttaccctcacagctcggcaggaatcaggaggtaggaatgctattaccaacagggattttcatggatggataaaaaggtcatgatgcaaatcctccaaaaaactgggctcaaaacccaagcatcttgtcctctaggccagcatgagaggtctgaagtgtcactgcctctagctaaaagagggaaggtcagacaaccctgtcctcctaaggccaataatgggaactctcaccaatgcataaagagacacattaaaaacgtatctcaaaaggcagcctggattgcagtcttttgcaatcaagaacctgggagtctaatgttcta

SEQ ID NO: 383097 - DNA, 404 bp, Homo sapiens
aagtagctgggattacaggtgtgcgccaccatgcctggctcattttttcgtgtttttaatagagacagagtttcaccatgttggccaggctggtcttgaactcttgacttcaaatgatctgcccgccttggcctcccaaattgttgggattacaggcgtgagccaccgcgcctggcctggaagcatttaagtaagaaaatataacctggtctctctccctaaggaagtcccttgagctcagatggcaggatgtgtaggggataagtagataaacctgcaagtggagaggaggatggtccaggcagagtgaagctgatacaacagcctttgcgagagggaccatggctggtgtggggaactgagatatctgaggtcagtgtggctggcagcagagctttatgggt

SEQ ID NO: 383098 - DNA, 441 bp, Homo sapiens
gaagagataaggatggctctgtatttattacttgagcgtttggttaggtggtgaggccattattcaaatctgaaatagacgaaaagagcaggttgagacaggagacatgggtgtgtttggtttagaacatgttatccatgaggtgttcaggttacactccaatcctcattctatcagaatggagctgcccagggggtattcccattggagaattggaacaaaaggattttcaaaaagcaactccaaaggacattttattgggtttaattatacctggaaccttagtcgtaagaagaaagaaaaggtagatttacagatgaaattctgatgtgaagccctatttaaagagtaattttttttctagctgttaaagaatactggtttacatatgaatactgaaagcatgactattgttacttttaattactaatatttaggtaa

SEQ ID NO: 383099 - DNA, 384 bp, Homo sapiens
ttttttttttttttttctttttttgagacagagtctcactctgtcgcccaggctggaatgcagtggtgggatctcagctcactgcaacctccaactcccaggttcaagcaattctcctgcttcagcctcccaagtagctggaattacaggcgtgcaccatcagactgggctaatttttatatttttagtagagacggggtttctccgtgttggccaggctggtctcgaactcctggcctcaagcaatctgcctgccttgggctccccaagtgctgggattatagacatgagccaccgtgcctggccctaagcctctgtgtttctttgctcagtatttcttctacctagaatgcccttctttttcatctggattatttaaacaca

SEQ ID NO: 383100 - DNA, 276 bp, Homo sapiens
aagaaaccctctccaggagacttctgcttacctctcagtgatcaaaaaccttttcaccacagttacttaccacgtcctaccgatccgcattctcgcaagtgtccttcactccatttactctactgcatttttcactgtatttctcatgccaaaacttgggcttctccaccagtctgcacacgttcatgctctcaattctcacagccatctatttcattctccactaaactgttagagggatttctgtagaaattaaagaaattcctatcactccta

SEQ ID NO: 383101 - DNA, 394 bp, Homo sapiens
atctcacagcatgtgtcccagctgaatagaagataggccaaacacttcgatttttagctatcatttaatgctttaagcaatatacaaagagtaaattaaataactctgttgcatatgggattccttggctgggtgtggtggctcccgcttataatcccagcactttaggagactgaggcagggggatcactggcatggtggtgcacacctgtagtctcaattactcagaaggctgaggcaggaggatcccttgagtcaaagaggctgaggttgcagggagctttgatggtgccactgcactccaggctgagcagaagagcgagaccctgtctcaaaaaacagcagcaaaaacaacaaaacagactttgcctcggtaaaagcaataagattaaaa

SEQ ID NO: 383102 - DNA, 403 bp, Homo sapiens
cttggaggtagggtttcaccatggacccacctcatctgcctaggcatttggctgcctcctgccactgtcactggaattttagcccagagtgccctcttgagtcattccctcaggctcaatgcccttactccaaagctgcagggcttgcagctctgtgagaaagggaggtggcagttcacactgcagaagcctcatcagttgagagacataaataagcaagtggatgttccttgttcttgaataggaagactcagtgctgcaaagatgccagctctccctaatgaatgtagcagctcaaagctatctcaatcaaaatctcatcacagtttgctttgtttcattgttttgccacttgatctaattattttaaagttcctctggaagagtatattttcaataataa

SEQ ID NO: 383103 - DNA, 375 bp, Homo sapiens
cacacacttggtgttccataatgctaggaaaatgagctcgtaattaccactcccttttaaatgtcaggttttttactttagctaggttcttcggttttatttatttactcactgaaaaatagtatactgagtgctatactatgcccctaaaccctgaattaggtgctaggtatacacagtgagtgaaagagataaagtccttgcccttttggagtttatattcaagcagtagaaagtgtctggtgcaaagtgttagcttttattgtattttttttttcctgtgtgagatttctcgccattcctcaattcaacaaatatgccttttttattttttttttaaaaataaatgttctatctctatagtactttttaaaa

SEQ ID NO: 383104 - DNA, 487 bp, Homo sapiens
agagaaatgaaaacatatgtcccacaaaaaattatagataaatgttcataggaacattatttataaaaaccaaaaactgggaacaacccaaatgctcaactgatgactggataaaaattaaatgtggcatatctatacaatgaaataatgattcatgctatgacttggatgaatcttgaaaacatatgataagggaaagaagtcagctttaaagaccacacattgtgtgactccatttatatgaaatgtccagaataggcaaatctatagaaacagtagattagtagtttgctagggttaaggggttgggggaaaatagagaatttctgctaatgagtgtgagtttcttttaagggtgatgttctaaaattgattgtgtgctgatagttgtacaactctgtgaatccacttaaaattattggattgtatattttaaatgggtaaatcgtatggtatatgaattatatctcaataaaactttttaaaa

SEQ ID NO: 383105 - DNA, 342 bp, Homo sapiens
ccatagtcagttaatggggtcacagttgattcctagtccccattctctcttaggagatgactctcagacaatgtttattggaagttgaagtataattgtgctcccacacaatgggagctcccattgtgtgagctctaattctccaagtgggctagctagagaatcaatagatcattcctatcagtcattaatatttctactactatttgatcttctgcctcctaatgccaaagttgcagaacaccatgtccaaaatctcagacctaaagcagaggcttctcttgctttggaactgaggcaaaagtggtagaccagtgagcttattggtaaattggtggatgg

SEQ ID NO: 383106 - DNA, 365 bp, Homo sapiens
aaaatcatcataggtaactcctgatgactcctacctctttcagtcacatacttagcattatctgctgtacaggtttaaagaattttggtcacaggattgaagtgaatatttcatttatgtgtagccaaaatattatcatatgaagcccaaaagaagagtaaaatacatccttgtgatattattaacatgactttgtgccagacaaagcatagttactctacagatggattatgaatagagacaaagtgtgtagttgaattctttggaattatggactatattccataaatcccagatggagtcactatgattaatgttacctcaatgaatacaaaatgaataaataattatcctccacttactgt

SEQ ID NO: 383107 - DNA, 382 bp, Homo sapiens
agttcacatgccatgaaaatctcccctgtggagtgccctgtcctatggttttagcatagtcaccgagttgtattcatggggtttcatgtctaccaagaataagattgttcttgcttaaattgtgaaagctttaccggtttagctcatagaaacagtcttggcaagagttccctgagataaaacttttcctgccctgtgaactttcttgttttgaattttaatgcattctaacatgagtgtctcatgttagaagctcagtgttgtggaggtcagtatagctattaaaaaacaatcccagcactttgggaagccgaggcgggtgggtcatgaggtcaggagatcgagaccatcctggccaatatggtgaaaccccgtctctact

SEQ ID NO: 383108 - DNA, 781 bp, Homo sapiens
gatttggagtggaccctccttcctccagagcctgcttcttaaccatggagcaaggagttctacatggcatgcccctgacctcattgcagctgttcatgttcttctccgttttagcaacattgaagaaaaggaaaataaaataaacataatttttggattttttaaaatggtggttgcttttcaaaagtaccagaaccgactcctgtcttccttgtattgtctctgttaaaatcgtgtgctttgcatgtcagactttacaacctgaatcaggctacatcaccagtccacctttgcaggtcaccactgtctcttactggaggcaggccggatcactgctcataggtaattttgtgaagaagctagtttcctaagtctattttcttttttctgtgttcgttcatggtatacgtgagagtgggggagtggggaggggggaaggagataaaaagaaaaaaaaaattccccagaacatattatgtgctcatgagcacttgcctgtgattgtaaatcagaaactgtaaaattgtgaagttctttgaagtttgcccaaaacctgctctgcagacacctgttctgctgggggccggagttggatggcctgcctctgctgcgatggctcaagctgtcactgcacaagaatgttccagcttgccttggcctggctgtcatcgctggctctgtcccactcaggcggttcaccgggttctgctgggcaccaggcttccaattagagagaaatcccactgtgtggccagccccaccagcgccgctctgagcagcc

SEQ ID NO: 383109 - DNA, 434 bp, Homo sapiens
aacactgtattaccttaccagcaatgagcagcgcctgcatgtttgtcccagtacttagggaagaactgattagctcttctaagtgctctcaggttaaacagttccgttggctctaccctgtacttctggcactttgtgggagagcattgcaaatagccaggtactacctctgaggtaggcttacatcttgacttagaaattattttttccccgatgggttaatgttgcttaacctgggaaacataatcagttttcagaggagagttacaaactttgaaatgtgtgcatgttcatttacatttgcatgtataaagcatatatctgaaactttttaacatttctgaaattgagatacatttttataattagtatatttgtataattgtataattagtataattgtatattttatgtgagaattgggttttctcctg

SEQ ID NO: 383110 - DNA, 340 bp, Homo sapiens
ccaatcaaaattccttcctgatcaggtttctggttcagatttcaaaatctctcctgggctgggcatggtggctcacagctgtaatcccagcactttgggaggccgtggtgggtggatcacctggggtcaggagttcgagaccagcctggccaacatggtgaaaccccatctctactaaaaatacaaaaattagttgggcctggtgatgcatgcctgtaatcccagctactcaggaggctgaggcaggagaatcatttgaacctggtaggtggaggttgcagtaaaccgagagatggtgccactgccctccagcctgggtaacagagcaagactatgtctt

SEQ ID NO: 383111 - DNA, 930 bp, Homo sapiens
ggtgttggggctctggtcttggatttgatgtgtggcgaaggctgcaattgtttaataacccttcatgattcaacagctcttcaagaactttcctctgttcttgtgtggagctcgtgacagccagtggtggtggagctccagccctctcttcccacaggcacaagccgggttcctgagtcccagggcttctcgggaggtgtctgccctcctctttcagacaccctctgccctgtgtcccagggccctgggcctgtgctgcactgagcagagactgtaggggaccggctctcccactcctcccagatgggcagcgtcttccgtgtcgggagcatgctgtgctgcttttctcttctcagtctcttagtttttgcgggttcttacgcatgtgaggtgtggacttgcatggtggggagctcaaatggtaacatgaaggggaggagccctctgagtgctgtgatttgttccatcattaccgcttcctgatcacggtgacctgcactgctggagtggtcagtggagccaggcctccccacaacagtgttcccatcgccttcttactattgatttctattcttaaaatattgtattacttagcactcttttgaagacgttccagtatatatcaaatgatcaaaagtccataaccttgtcctacgtagaagccaaaggtgtcatgcagtttcaggtgttcgaatttccagaattcttgtgatgacatttgtaggattcttcttttagacttggaccaaattctgtaacctaatatttgtccttcagattgacagagaaccgcaggcagtgttttctctgtcacacgtgtggtgggtggcatcctggtgacataaagaattgcctttggtaacttgcccagaaggctgtagggttattttctgcttagactttcccctatttctttcttttcttttcttt

SEQ ID NO: 383112 - DNA, 436 bp, Homo sapiens
atatgttattttcactaataactcacaatcagtgcatatatctggcaatatatatctattacccttgaataaatttataataatacttaaatcatcttaaattctgtaagaatgccatgtattttaaatacgcttttctgaaaaatatcttgtaatatatattttgctggagagaaacatacaactagaaaggaaatatgaggaagattgttatgttgtcattagactactagattagaagcttattgaatatctgctctactatcatattaataatattaattttattacaaattaagatctaataataattgttagaatttatgtttttaaaattggatttaaaagtagattattttgtcaatgccttttaaaaatttcccctcacatgttaagaaaaaatatctaagaatacttaataaatgttttaaatata

SEQ ID NO: 383113 - DNA, 435 bp, Homo sapiens
gattttacctaggatgaaaggtggacatagggctgggaggcaaaaggggatgtgagattcagagctttcaacttcctcgcctatgcagattcctggcaccaccaccacctccacccccgccccgcaattcctccctccgcaatccccccaccccgccctccccaatctcttaaaccagatcacaagtgggtgtggattaagtgcatgaggggccctggaaacgcagaatgcaaaattcagggggcggagacagaaaagccacgcactgggagcctcgcctccgcttgccccgcccccgggttgcgccgcccccaaattctcggcgccaggagtctagggttgaaatgattgacacagctacttgttcaatcagaacagttctacccccttagactgagtttctttttggaaagagttacctgatctttagttaaa

SEQ ID NO: 383114 - DNA, 319 bp, Homo sapiens
caaaaagattatgttgtgccaaagaggtcagatacaaaagagtgcatgacaccatttatataacatgacaccatttatataaaattctagataattcctacagtacaatagcagatcagtgggtgcctagggtcagggaagaggggtaaggattagctggacaggggcacaaggaaaccgtctgaagtaatagaaatgttctgttaaatgtggtggtggttacactgctttgtatatttgccaaattcatagaacttaaaatgggtgcattttcttgtaggtgaattacaccttaataaagctgacttcttaggacaat

SEQ ID NO: 383115 - DNA, 2428 bp, Homo sapiens
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtga

SEQ ID NO: 383116 - DNA, 4468 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttta

SEQ ID NO: 383117 - DNA, 4562 bp, Homo sapiens
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttta

SEQ ID NO: 383118 - DNA, 5239 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaa

SEQ ID NO: 383119 - DNA, 3586 bp, Homo sapiens
tagaggatcccccatgttggccaacgtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaa

SEQ ID NO: 383120 - DNA, 3255 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttgggtctgttcttgggggatccttctagacca

SEQ ID NO: 383121 - DNA, 1067 bp, Homo sapiens
  misc_feature (882)..(882): n is a, c, g, or t
  misc_feature (925)..(925): n is a, c, g, or t
  misc_feature (1050)..(1050): n is a, c, g, or t
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatgaattcccttcctttttaaggttgaataatactcccatgtgtgtatatatcaccttgtttatccattcatctgtcgatggacatttacattgcttccacattttggcttttgtgaataatgctgctatgaacatggtancacgtgaagttttgtttttctttttaaatgaatcttctcattnttacgtaattgtagattcacatgccattgtaagaaatacacagagagatcctgtgaactttttaaccctcatagtaaatatagagtaaaaatcttattctataatatagtacaatgtccacccanggtattgacatgataca

SEQ ID NO: 383122 - DNA, 266 bp, Homo sapiens
agatctctcccagggagaggagaatgagccacgcgttccagagttgcaggatctccagggcaaagaagtgccccaggtctcctacttgggtgagtaatgattccagaactgagtggacagagtagggggaagggttgctggcagccggaggtgagcccactctctggcttctctctgcggcccctaattgccttcttcatttccccagactctatgtgggtcttgcatgtcttgccttgtccctgacttttcatagaaagaatgga

SEQ ID NO: 383123 - DNA, 4515 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttta

SEQ ID NO: 383124 - DNA, 4623 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagaatttttcaatttaataatcatcgcagcaatggttatattttagaaatgttaggaagtggagggaagaaagcacagataatttcagtcctgtcacagatctacgtgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggctttta

SEQ ID NO: 383125 - DNA, 5259 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaaaaaaaaaaacacccaaaaag

SEQ ID NO: 383126 - DNA, 5118 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgacttaatctgcaagtcaaaccagacgggtattttgtattattcatatgtcacatcctaccaacagacagtaagtcaggcaaggctcctggtgctccttgtcaacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaa

SEQ ID NO: 383127 - DNA, 3265 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtattttagacgatgacaactcctgacttccattaaactg

SEQ ID NO: 383128 - DNA, 1702 bp, Homo sapiens
ccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagttccagctggcagtgtttctgctggtatataatactcagaaaccctgccctccatgcagtccacagggttgcaggccgtcagacgagggtgtcctccatagaccttcctggataacctcatctctgttcctggcttctgttgagatggttgattggatccgtgaatcatacccagaatctctttaacaaatgatgagccagccacactcttggtgtctctccagtgcacgctttcttattttttgccgtatggatagacagaattttccaaatcttgaagtcatggttcctttttgctacaacaattccttcttcagtttatctc

SEQ ID NO: 383129 - DNA, 485 bp, Homo sapiens
cctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaa

SEQ ID NO: 383130 - DNA, 833 bp, Homo sapiens
  misc_feature (48)..(49): n is a, c, g, or t
  misc_feature (52)..(52): n is a, c, g, or t
  misc_feature (58)..(58): n is a, c, g, or t
  misc_feature (64)..(64): n is a, c, g, or t
  misc_feature (85)..(85): n is a, c, g, or t
  misc_feature (88)..(88): n is a, c, g, or t
gccggggagggccccgcccgcgcccggaacagataaggtttttggccnnggnggtgcngaggtntgagatcttatttatacattnatnacctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383131 - DNA, 1591 bp, Homo sapiens
aggaggagcggggcggggccggcggcgggcggccgggctggagggccctgccgggggtggggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383132 - DNA, 2448 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaa

SEQ ID NO: 383133 - DNA, 2226 bp, Homo sapiens
  misc_feature (1833)..(1833): n is a, c, g, or t
  misc_feature (1837)..(1837): n is a, c, g, or t
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcanaaanaaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattggtaaacctctagccagacagatcagaaaaaaacacgaaagacacaaaccagtctcagaaatgacaggtagcatcattac

SEQ ID NO: 383134 - DNA, 1521 bp, Homo sapiens
gtgcacgttgagattcctcggcgggtaggcagcggtgctgggcatgctcagtgggcaggacccgttagagtggcgagcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383135 - DNA, 2425 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaa

SEQ ID NO: 383136 - DNA, 1565 bp, Homo sapiens
gtgcacgttgagattcctcggcgggtaggcagcggtgctgggcatgctcagtgggcaggacccgttagagtggcgaatggagtctcactgtgtcacccaggctggagtacagtgtcgttatctcagctcactgcaacctccgcttcccaggttcaagcgattctcgtgcctcagcctcccaaatctgggattacaggtgaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383137 - DNA, 1439 bp, Homo sapiens
atgcagattctgcccaagaagcccctgcattgcagagggactggagatctgtatgatctgtttatttcgcaattgacaggccataaggatgagtttaccattattcctgtactggttggagctctgagtgagtcaaaagaacaggaattcggaaaactcttcagtaaatatctagcggatcctagtaatctctttgtggtttcttctgatttctgccattgggccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383138 - DNA, 1300 bp, Homo sapiens
gtgcacgttgagattcctcggcgggtaggcagcggtgctgggcatgctcagtgggcaggacccgttagagtggcgagaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaaggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383139 - DNA, 997 bp, Homo sapiens
tatgtacaagggctcttgggaatgattctctcagaggcttaagctgtgctttgcctttcatgagaactgaaattatttggtaagcgcttgctttctttttagcttctaatttttccctattttattttgtacatgatatttgtttcaaggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383140 - DNA, 1443 bp, Homo sapiens
ctatatttatttattcacatatattttgaaaagagtgatgcgccttaggtgtacaggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaa

SEQ ID NO: 383141 - DNA, 1723 bp, Homo sapiens
  misc_feature (1723)..(1723): n is a, c, g, or t
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcggctcttttggctcagcggtggaacttctggggcgtttgcttttagggaggggaattgatgatcctcgctcatgaactggtggccttggtcgatcggtgcgggaggagttan

SEQ ID NO: 383142 - DNA, 861 bp, Homo sapiens
gtgcacgttgagattcctcggcgggtaggcagcggtgctgggcatgctcagtgggcaggacccgttagagtggcgagtaaggaagcgttggctcttctccgggtctgccttccccggttcaggccccggccctgggcttttgtgtgcgcgtagctgcagccgccactgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgcccctagagacgggagttttaccagcctgggcaacatgccatgcaggatatacgtactgtgggtcttgtgctgcccatgcttataaacaagtggatccgtctattacgtaagtaatgtagttttgttttaagtcggagaagcttgagaatttattgctttgttatagaagtaatttgctttttatacttattgttattatgtactcaatttcatgagggatttgacttttgatgaattttactatactttgtataggttactgaaaacttcaatacttcttttttgttgttgttggagcatttgatttttaccttccctttggcatgtaaaatgtttagttatgaaggttaaatattttgttttttgatatttctttgaaaacccagagatgagcattcttaagaaaaatgcaaagccctctgatctgttttaatcatttcgtaatttaagattctttattgtacttgttaaaattgtggttactgaaaggataatttctcgttgacag

SEQ ID NO: 383143 - DNA, 2041 bp, Homo sapiens
agccaatttttctcagcattgtttctggacctttctgagggtgggatctgggcatcttcaatggcttaacaagtatcacagatgaggaaacagacttggagaggttaagtgacatgctcaagacaacactgctggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattgggggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaa

SEQ ID NO: 383144 - DNA, 1831 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383145 - DNA, 1801 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataatttgttatgcggcaagttttttgccttggtttttaatatatacgaaacaata

SEQ ID NO: 383146 - DNA, 1754 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattgggggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383147 - DNA, 1611 bp, Homo sapiens
tggggtcactcgcggtggctcggggaggccagctgggaggggagggggccgtgggggcggctcggcggaaccagccccggctgggcagcagcggggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactc

SEQ ID NO: 383148 - DNA, 1347 bp, Homo sapiens
  misc_feature (349)..(349): n is a, c, g, or t
cgctgtttttctgctcgatctgtgtgatggagttcgtcattcgttctgtgcgttggtttgggtcggtgatgtgtggtcgctggtgttattgtccgcgtgcgcagtctgtatgtgtctggttgccgtcttctgcgctagttccgtctttgttccactggccgcgttctgttagccgtgggtcttgttcctgtcgtgttttgttccttgctgtgttgtttttgtggctctttgtgtttctctttttcttttttttttttttttgttttcgtttgtttctcttttttgtttttttttttttgttttgtgtttttcttttttttttcttttttgttttttttttacccagccnttgaaaccaataagcatttattatatcactgtttcagaatccccccaaaccaggaccagtatcgtggtaaaggctaggctgggaccccggacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaa

SEQ ID NO: 383149 - DNA, 1865 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggtgagtcagggcaggggggtggtgagggggtgcccctggaggctgcgagcctaggctgtccccgccaggccaccacctggctggcagcagctgtttacaggagtatggactgcccttcatggagaccagcgccaagacgggcctcaacgtggacttggccttcacagccatagcaaagtaagtcctgccagtcaccaggactcccccagcccagggcctgaatcctcattagagtccaggccatcgtgtccccttgtcacccccactccgcagggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaa

SEQ ID NO: 383150 - DNA, 1769 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggtgagtcagggcaggggggtggtgagggggtgcccctggaggctgcgagcctaggctgtccccgccaggccaccacctggctggcagcagctgtttacaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaa

SEQ ID NO: 383151 - DNA, 799 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggtgcataaggcatttaggtttttcaggggcagtcatcatttttgatatttttcg

SEQ ID NO: 383152 - DNA, 1669 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaa

SEQ ID NO: 383153 - DNA, 1566 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggtgagtcagggcaggggggtggtgagggggtgcccctggaggctgcgagcctaggctgtccccgccaggccaccacctggctggcagcagctgtttacaggagtatggactgcccttcatggagaccagcgccaagacgggcctcaacgtggacttggccttcacagccatagcaaagtaagtcctgccagtcaccaggactcccccagcccagggcctgaatcctcattagagtccaggccatcgtgtccccttgtcacccccactccgcagggagttgaagcagcgctccatgaaggctcccagcgagccgcgcttccggctgcatgattacgttaagagggagggtcgaggggcctcctgctgccgcccttgaacctggctgagctcagtcctctggaggaagccgcccagtcccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaa

SEQ ID NO: 383154 - DNA, 800 bp, Homo sapiens
cgggcgcccgggatgatgccgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctggccatgaacttatgggggaatagggtaggccgtgataagcttggcaaaggtgaatagagccatggtggtttcgtgtttcctctttgagcgtatcttgcttgc

SEQ ID NO: 383155 - DNA, 525 bp, Homo sapiens
aggccagacacagcagcaactgggacccaggaggatggagcagctgtgtgttagtctggccccagggagtggggtacagcagcaactcagcttaaaaatggtgtatcactgtgcaacccaggctctgggggtattgggtgcagtggcagcaagtcccaggaatgaagggcacagtgtcttctaaggtccccgaagtagagcacagagcagcagtggctccagttctaagatgtcatagcaccataacagctcaggccatggagacagggtgcagctgcagctccctctttgggaaaagcaccaggaacatctagtcattcatctttctgacatatctccatccagataggattcttggttgacagggttttttttttttccttcagcattttgaacatatcaactcactgccttctggcctccaaaatttctgctgatgatcttattggcataccttgtgatatggtttagatgtttgtctcttctaaatctcatgttgtaaaaagaataataagcaaaaaaaaa

SEQ ID NO: 383156 - DNA, 784 bp, Homo sapiens
aaatatctctgtccccatctttcagtttcctacccaagactcctgtgtggttgacatcactgctgtgtgcagtgttcatgtccatataagtcagaagtggcttgcagcagtggtttggggctttggggcctctgctcgctccttatcaattcttagggttacatcctctgggaagatgccaggcctggtcaagtgtggcctctgacctagagttatgcaaggcctctcttcctcctgtggccagtgtgaaatttctcatctgtgctctcctgcctctagcaggaaggttggcctacatttggggcacatctctgtcactgtctcaggccaggggttcaaatataagacctgaatcatactgcacctcagaacccaaacccttttacttaattttttttaaaaaatttcattcagatggtaaaggttcaaacaatacatagagatataaaacagaaagaaaaaaaaatacacgcctctctctagtacctattccccagtagtcaacactgctaccttttttttgcaggggaggtaaattcctccagaaaaaaacttaaacatctacaatttcatatatcctctcccctcttccctaaaaaacaaaacaataacaacaaaactatagaaatgggattatgctatatattctgttcagtacttttttgtttttgaaaatttaaaaaatatgcaaaagaagaaaatgtcatccatattactaccacttataattaaccactaattaacttttaggtgtgtttgcttcttgtctttatgaatatacttt

SEQ ID NO: 383157 - DNA, 2557 bp, Homo sapiens
tgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383158 - DNA, 2555 bp, Homo sapiens
tggagtttcactcttagggaccaggctggagtgcaacggtgcgatctcggctcatcacaacctccacctctcgggttcaaacgattctcctgccttagcctcccaagtagctgggattacaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383159 - DNA, 2490 bp, Homo sapiens
aagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctgggtgacagagtgagactccatcacaaaaaaaaaaccaaaaaacaaaaacaaaaattagccgggcatggtggcgcatgcctgtaattctagtacttgggaagctgaagcaggagaattgcttgaacctgggaagtggaggttgcggtgagccgagattgcaccactgcactccagcctgggcaacaagagtgaaactccctctcaataaataagtaaataaataaataaataaataaagggacaggcagagggctgacaaccgaaacccctctatttcctttgtgtgtccaagaaggaggaagcagggagaagggatgatggaaaagggaagggatacatcagactagggggtggagggtgactgaccccaggagacaagtgtagcttgaatatatacccagacaattccagtctccccttcctcagtactctagttcaatactacttccatggtcatctgctagacatctcttgtgtcccaagcactgtgtttgtaatcttgtggagaagatggaagttgaaacgaagaaccatagcccaaggagaatgaagtcaggcctgcgtaatggtaaagcaacattgtggtatacagaggccaataataatcctagatggaaaaatcaggagggcttcttggaggtgatattcatctgagggtaacttactgcttgttcctggtggcatgctcataatccacttctctcttttcagtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383160 - DNA, 2182 bp, Homo sapiens
gctcggtacccccctccccgggtacttgggaagctgaagcaggagaattgcttgaacctgggaagtggaggttgcggtgagccgagattgcaccactgcactccagcctgggcaacaagagtgaaactccctctcaataaataagtaaataaataaataaataaataaagggacaggcagagggctgacaaccgaaacccctctatttcctttgtgtgtccaagaaggaggaagcagggagaagggatgatggaaaagggaagggatacatcagactagggggtggagggtgactgaccccaggagacaagtgtagcttgaatatatacccagacaattccagtctccccttcctcagtactctagttcaatactacttccatggtcatctgctagacatctcttgtgtcccaagcactgtgtttgtaatcttgtggagaagatggaagttgaaacgaagaaccatagcccaaggagaatgaagtcaggcctgcgtaatggtaaagcaacattgtggtatacagaggccaataataatcctagatggaaaaatcaggagggcttcttggaggtgatattcatctgagggtaacttactgcttgttcctggtggcatgctcataatccacttctctcttttcagtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383161 - DNA, 1838 bp, Homo sapiens
cctacttgctcttctgttctgcctagtggtaagtattttctggagcttctgctgaaggagagggaaccacttggttcctggtctgacttcagaaggagtcctggggagagcctcccagccctcccctcagcttctccctggtctcttccagtcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383162 - DNA, 1892 bp, Homo sapiens
tgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagctactcggggggctgagactggagaatcacttgaacctgggaggtggaggttgtggtgagccaagattgcgccactgcactccaacctgggcgactccgtctcaaaaaaaaaaaagaaaac

SEQ ID NO: 383163 - DNA, 2027 bp, Homo sapiens
ctgggtgtctggatgtgtggcggtagcaaggcctagttttcttttttgtattctagtcgttcagccccctcccctcccatcttccagcgcttctgaacaactcctactgttctcttcccccaacagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383164 - DNA, 2265 bp, Homo sapiens
tggagtttcactcttagggaccaggctggagtgcaacggtgcgatctcggctcatcacaacctccacctctcgggttcaaacgattctcctgccttagcctcccaagtagctgggattacaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcagtcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaa

SEQ ID NO: 383165 - DNA, 1158 bp, Homo sapiens
  misc_feature (732)..(732): n is a, c, g, or t
  misc_feature (736)..(736): n is a, c, g, or t
  misc_feature (776)..(776): n is a, c, g, or t
tgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtctttatcgaccaanaatnttacagcaggagctcataaaggatcgtgcagtgaagacangaattgcaacatgaggatggtgcattcccggagagctgcggggcatagggcatccaccccaagtagttatctcctcggattcaccaaagtcagctccctgggatgatcttggctggcaggtcatcattggaaaggcttgagaaattggccttcatgcagaagagtcgaggtcctggcacgcccattggaggtcatggtgaaggggggcttctcatcctcatggtgccagggggtgtggctttcccacaaaatggtaattgccattctatcggaacgagtcccaaacatataggcagttggaatgtgctatgtcgaaggtcaggccctcgaggggtacagtacacctcaggggaggtcctccggagggagcgaggtggggcca

SEQ ID NO: 383166 - DNA, 439 bp, Homo sapiens
atatttgggatagggaagggaagcttgggattttagctacgtagagacacttgaaaattggagggaggaaaggagtgggtggctttggagatgttctggaatatgtgaatgaggggagtggaggggtcctggaggctctggggaaggccaagcccgttttcctgtctttcaacctcttccaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383167 - DNA, 330 bp, Homo sapiens
  misc_feature (30)..(30): n is a, c, g, or t
  misc_feature (137)..(137): n is a, c, g, or t
gatctggctgcgctatgactccgggagcgncacccacaacatgtaccgggaataccgggacctgaccaccgcagcgctgtcacccagtgctaccgagacatgggtgcccggcacgcgcccgagcccactccattcanatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383168 - DNA, 1055 bp, Homo sapiens
  misc_feature (825)..(825): n is a, c, g, or t
aatacggctaggtacgaggctgggtgttaatcggccgaggtgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgcaatgcagaaacctgtggaaagggggantcttcagatcaggatgatacctgtacttttggggcccagtgtgccggcattgcgctgctcagaacaaatgcgtgctggggtcaatgtggagggctcaaggacatctgtgaatcggcagagcgcgaaggcgggagccatagggtcgcccgtctcgagagggtcctgttctatgccgcccttggcataacacaggggggtaaaaaagggaggcgcgtatacttatcgtagac

SEQ ID NO: 383169 - DNA, 765 bp, Homo sapiens
cacttcctgtgtgctggaacagcattcatgcctcatggacaccatctccttttatcattgtgacaacctagaaagaagtgtaggatcaacaggctgttttacagatgagggaactgggccgtagcaaggtgtgttccttttccactctgctgtggggccaggaggctgacggctttgcacagtggcgtctgtagggtttggagagtggcacccataggagatgagatggagagggtgaggttgagcatttacctccccagttgccattctagggaccattctctccctatcccttggaccttacaggggtaacaaagcccactgttattagatctggggtaatgcactatccgttgtggtttaccaacaccctgcccattcctttgtataatcctgttatgaaacaccttcaaattatcccatttaagagaatgaattctttatttcctgaagaaaccctaccgaatacacttgtctgatgcaaaaagtcttgtcaggagtggagctgggattcaggcccagatagtggagctccagagcccgagctgtaaccactaagctccatgcctgccccttgggactgtttcagtgggtgggaaagggagaagtctctgactctggagttggaaaagaaagagagagatagtagagaggacttccggagggaaatgagcatggggcctcatctttctgtatatagaagacacaacaaataaagagagacaaaatttgtacccacagagaatgtggcagacttcagggact

SEQ ID NO: 383170 - DNA, 1289 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383171 - DNA, 1392 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383172 - DNA, 1663 bp, Homo sapiens
  misc_feature (1301)..(1301): n is a, c, g, or t
  misc_feature (1304)..(1304): n is a, c, g, or t
  misc_feature (1312)..(1313): n is a, c, g, or t
  misc_feature (1316)..(1316): n is a, c, g, or t
  misc_feature (1319)..(1319): n is a, c, g, or t
  misc_feature (1322)..(1322): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaanaanaaaaaaannaanaanaanaaggataaaacaagaaggaaacaaaactacaggcgcagcccgtgctccatttctttcaaacgggagccgaattacatgacaaatgaaaatctttggggggggccgcggccccaattccccctatagggggcaggttaaaattattgcccgggttttaacaacggaggatctgggaaaacctggaggtcccaacttaacgcctttgaagaaaatccccttttgccaaggtgggtataaccaaagaggccccaacccgttggcttttccaacagttggccatcttaaagtgcaatgggattttttccgcggtaaatttgtaaaaaatcccgtgaaattttggt

SEQ ID NO: 383173 - DNA, 1294 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcaggctcgtagcttgccatgggatcctctagatcaccccgcaca

SEQ ID NO: 383174 - DNA, 1246 bp, Homo sapiens
  misc_feature (1229)..(1229): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaaccgaaaatnacccaaaatttcccggg

SEQ ID NO: 383175 - DNA, 1242 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccgtctttctggggcttgcgcgcaaaatctacaagcggagaaagtgacctagagattgcaagggcggggagaggaggctctcaataaataatcgtgtaacctt

SEQ ID NO: 383176 - DNA, 1940 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgacctcggtgtccttccccgcagctcttgtcctcactggccgggcttcaccacctctgtcttctaggtctgggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaaca

SEQ ID NO: 383177 - DNA, 1110 bp, Homo sapiens
  misc_feature (1046)..(1046): n is a, c, g, or t
  misc_feature (1051)..(1051): n is a, c, g, or t
  misc_feature (1054)..(1054): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaatgcagtggctggtggtcagtgtctgcaaggggcactccgacagtccgatctgaggaaatcggggaaggggtgaaatgnggganggnatagggggttgcggggttatgggagtagttggttagggcgccggttgggggaaaaa

SEQ ID NO: 383178 - DNA, 1150 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaacacaatgcgtggggggggcaggctggaagggccccaaaaatccatcgggagaaaatcgccgagggggggaaaggccgggaggcaaagaggctgcgccggctcgtaatgagaaaccttggctaaagacccccccctgggggacagagaaaggggggggaataaacaacacggggaggccgcgctcacatgc

SEQ ID NO: 383179 - DNA, 1331 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcgattattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttccggtcacgagatggtaccgagctcgattcactgcctgtca

SEQ ID NO: 383180 - DNA, 1488 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggcaggtaagaaggcaggaggcagtagcagagaacaggcaccagcttcactcctcctctgcccaggaacctcatccttcctcttttgctgccctccccagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383181 - DNA, 1212 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggcaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383182 - DNA, 2074 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggtgagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaggaaggtggatcagaatgacttggggactgacatttgtgagggaagagacaggctgtgcacctctagaatggattcatctcttttatgactcccaggaaggcctagccaaaaataagtgggattgaggttggaccatcagtcaggactgtctaggtcagggaagccaagatgtctgaagagagaggaaagatttggggctgcagtagggcaagaccccatgggaggaagcagccaggaagatgccggcacccctggggtttggcttattaacccccctttccctgcaggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383183 - DNA, 1343 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383184 - DNA, 880 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacattggcaggaattgatggcgagaaggagcacgccaatgccaagaagatctgctggagatggggg

SEQ ID NO: 383185 - DNA, 2176 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggtgagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaggaaggtggatcagaatgacttggggactgacatttgtgagggaagagacaggctgtgcacctctagaatggattcatctcttttatgactcccaggaaggcctagccaaaaataagtgggattgaggttggaccatcagtcaggactgtctaggtcagggaagccaagatgtctgaagagagaggaaagatttggggctgcagtagggcaagaccccatgggaggaagcagccaggaagatgccggcacccctggggtttggcttattaacccccctttccctgcaggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383186 - DNA, 855 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctacctggcaggaattgatggcgagaaggagcacgccaatgccaagaagatctgctggagatggggg

SEQ ID NO: 383187 - DNA, 1479 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383188 - DNA, 1765 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagggtacaggattgcagcgtgcctggaagggaaagaaagcgaggaagggtgttgggaagtggggttgtggtagtggcaagaaagggcttctctgtcctgtgtaattggaagaaagggtgataaaggactgtgtgtatgaatatgggccttaagttttggggctttctccccttctgttgcctttctgattctgcccagttgtcagctggtatgggatgttgggcttgggataccagggtttcgcatatctggagaaagcctggctcatggaccgtctttgtcttgcttagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383189 - DNA, 1392 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcgattattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383190 - DNA, 1561 bp, Homo sapiens
taaaagtctatatttttatattggggggagggagtagaaaagcaagcccctatactgggccctattcagtggcagcttcttgttccataggattaaggaagactctgaggaaataaaagttgtttggaaaaatccaggtgtagttgctttgtatgttgtgatgggtagaagggatgaagtgaagtgtgaaggcccctcataccctccatcttgcctcagactatgtcctggaaccctggggcggagaaagcgccactttcattcctgcttcttgggattgttgacggccacgtagtgatagagaacgacaagcaagaagagcgacacgcccagcatgttggcgaagatggcgagctgcacgtccgtgatcatcctgaccagtccggctcggctccgacgccaccagcgaacctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383191 - DNA, 913 bp, Homo sapiens
tctgtgccccgccgggcggggacgtgggagccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaaca

SEQ ID NO: 383192 - DNA, 801 bp, Homo sapiens
  misc_feature (740)..(740): n is a, c, g, or t
tggtacggtcggagtattgggatggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttnctatagctgaaccctgacataggaagaattattgcgaaaagacccccccatcccaaccccc

SEQ ID NO: 383193 - DNA, 1720 bp, Homo sapiens
  misc_feature (1301)..(1301): n is a, c, g, or t
  misc_feature (1304)..(1304): n is a, c, g, or t
  misc_feature (1312)..(1313): n is a, c, g, or t
  misc_feature (1316)..(1316): n is a, c, g, or t
  misc_feature (1319)..(1319): n is a, c, g, or t
  misc_feature (1322)..(1322): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaanaanaaaaaaannaanaanaanaaggataaaaaaatctaaaaattgagggggtgccccgctacccactttgccctatatagaaatagattacaatgcaatgggcgaacaattacaccttgggggactccaaaacccatatttttgcaaaatggagtcgctttgcaattaacgtggcctttctgtaacatggcgtaatatggaaaaacccggggtttcccgaccctatcaccagtggggcaaaaccgacttttataatggttaattaataagctttagcgcctccgtacgaaactcccctttaaaacaattggacaaccaggatttggcataggccaatattgtggcgttaatcttttggctaaatcggcctaacaattgtccaagaagagtttatttttaaataacacgcggaaaaaggg

SEQ ID NO: 383194 - DNA, 1368 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttcaaaaaacacacacatttcacccacaacaaaacgaaacagacaaaaaaacttttttgggcccctctgggccccgggaac

SEQ ID NO: 383195 - DNA, 1297 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatccaccaccgccaccccttccttggtgagggtatcccctgtgtgtgccggctctctataatttatcggcgcacccccaaaaaaa

SEQ ID NO: 383196 - DNA, 1192 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgacttgtatcatcagttgttagtatttgttttagctggggaggcagctggagcatgaagtcaacaggaacaatgatgatctgcagggaggaaagccctaggatggcgggatattaccat

SEQ ID NO: 383197 - DNA, 1107 bp, Homo sapiens
  misc_feature (1031)..(1031): n is a, c, g, or t
  misc_feature (1036)..(1036): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacacaaatgcagctggtggtggtcagtgtccgcagggccctccgaacgtccgatcctggggaatcggcgnagggngggaaaaggcggggaagggcaaagagaggggagcacccagggtgtgccattgggaagacccccatgggcca

SEQ ID NO: 383198 - DNA, 1290 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcgattattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383199 - DNA, 1148 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383200 - DNA, 1291 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagagttcctatcagactgagaatgggcagaccctggacctcctcacaacgccccagccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383201 - DNA, 1139 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 383202 - DNA, 1105 bp, Homo sapiens
  misc_feature (875)..(875): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgcaatgcagaaacctgtggaaagggggantcttcagatcaggatgatacctgtacttttggggcccagtgtgccggcattgcgctgctcagaacaaatgcgtgctggggtcaatgtggagggctcaaggacatctgtgaatcggcagagcgcgaaggcgggagccatagggtcgcccgtctcgagagggtcctgttctatgccgcccttggcataacacaggggggtaaaaaagggaggcgcgtatacttatcgtagac

SEQ ID NO: 383203 - DNA, 1110 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgtcaaggtaatcatcctgaataccagaatgcagatgtttatgcccgagaaaagccggattccgcttcggcagcattctcccagtgtcgctcagggtgctgactcggggactgcgatggggcaccaagagactgggagatgcgtatcgccgggtcacggaggtctgcggtacactgccttggctgccggttttccgggcgtcgccggggagaacttccccgggctgtgggcctggagacgggtgctgtcgctccacggc

SEQ ID NO: 383204 - DNA, 1562 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggtgagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaggaaggtggatcagaatgacttggggactgacatttgtgagggaagagacaggctgtgcacctctagaatggattcatctcttttatgactcccaggaaggcctagccaaaaataagtgggattgaggttggaccatcagtcaggactgtctaggtcagggaagccaagatgtctgaagagagaggaaagatttggggctgcagtagggcaagaccccatgggaggaagcagccaggaagatgccggcacccctggggtttggcttattaacccccctttccctgcatggcaggaattgatggcgagaaggagcacgccaatgccaagaagatctgctggagatggggg

SEQ ID NO: 383205 - DNA, 857 bp, Homo sapiens
  misc_feature (796)..(796): n is a, c, g, or t
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttnctatagctgaaccctgacataggaagaattattgcgaaaagacccccccatcccaaccccc
